US009617539B2

(12) United States Patent
Rigo et al.

(10) Patent No.: US 9,617,539 B2
(45) Date of Patent: Apr. 11, 2017

(54) MODULATION OF UBE3A-ATS EXPRESSION

(71) Applicants: Ionis Pharmaceuticals, Inc., Carlsbad, CA (US); Baylor College of Medicine, Houston, TX (US)

(72) Inventors: Frank Rigo, Carlsbad, CA (US); Amanda Ward, Carlsbad, CA (US); Linyan Meng, Houston, TX (US); Arthur L. Beaudet, Houston, TX (US)

(73) Assignees: Ionis Pharmaceuticals, Inc., Carlsbad, CA (US); Baylor College of Medicine, Houston, TX (US)

( * ) Notice: Subject to any disclaimer, the term of this patent is extended or adjusted under 35 U.S.C. 154(b) by 0 days.

(21) Appl. No.: 14/409,348

(22) PCT Filed: Jun. 25, 2013

(86) PCT No.: PCT/US2013/047701
§ 371 (c)(1),
(2) Date: Dec. 18, 2014

(87) PCT Pub. No.: WO2014/004572
PCT Pub. Date: Jan. 3, 2014

(65) Prior Publication Data
US 2015/0191723 A1 Jul. 9, 2015

Related U.S. Application Data

(60) Provisional application No. 61/772,925, filed on Mar. 5, 2013, provisional application No. 61/755,617, filed on Jan. 23, 2013, provisional application No. 61/750,939, filed on Jan. 10, 2013, provisional application No. 61/738,959, filed on Dec. 18, 2012, provisional application No. 61/664,083, filed on Jun. 25, 2012.

(51) Int. Cl.
*C12N 15/11* (2006.01)
*C12N 15/113* (2010.01)
*C07H 21/04* (2006.01)

(52) U.S. Cl.
CPC ........ *C12N 15/113* (2013.01); *C12N 2310/11* (2013.01); *C12N 2310/111* (2013.01); *C12N 2310/113* (2013.01); *C12N 2310/315* (2013.01); *C12N 2310/321* (2013.01); *C12N 2310/323* (2013.01); *C12N 2310/3341* (2013.01); *C12N 2310/341* (2013.01); *C12N 2320/30* (2013.01)

(58) Field of Classification Search
None
See application file for complete search history.

(56) References Cited

U.S. PATENT DOCUMENTS

| | | | |
|---|---|---|---|
| 4,981,957 A | 1/1991 | Lebleu et al. | |
| 5,034,506 A | 7/1991 | Summerton et al. | |
| 5,118,800 A | 6/1992 | Smith et al. | |
| 5,166,315 A | 11/1992 | Summerton et al. | |
| 5,185,444 A | 2/1993 | Summerton et al. | |
| 5,319,080 A | 6/1994 | Leumann | |
| 5,359,044 A | 10/1994 | Cook et al. | |
| 5,393,878 A | 2/1995 | Leumann | |
| 5,446,137 A | 8/1995 | Maag et al. | |
| 5,466,786 A | 11/1995 | Buhr et al. | |
| 5,514,785 A | 5/1996 | Van Ness et al. | |
| 5,519,134 A | 5/1996 | Acevedo et al. | |
| 5,567,811 A | 10/1996 | Misiura et al. | |
| 5,576,427 A | 11/1996 | Cook et al. | |
| 5,591,722 A | 1/1997 | Montgomery et al. | |
| 5,597,909 A | 1/1997 | Urdea et al. | |
| 5,610,300 A | 3/1997 | Altmann et al. | |
| 5,627,053 A | 5/1997 | Usman et al. | |
| 5,639,873 A | 6/1997 | Barascut et al. | |
| 5,646,265 A | 7/1997 | McGee | |
| 5,670,633 A | 9/1997 | Cook et al. | |
| 5,698,685 A | 12/1997 | Summerton et al. | |
| 5,700,920 A | 12/1997 | Altmann et al. | |
| 5,792,847 A | 8/1998 | Buhr et al. | |
| 5,801,154 A | 9/1998 | Baracchini et al. | |
| 6,184,212 B1 * | 2/2001 | Miraglia | C07H 21/00 435/325 |
| 6,268,490 B1 | 7/2001 | Imanishi et al. | |
| 6,300,132 B1 * | 10/2001 | Monia | C12N 15/113 435/375 |

(Continued)

FOREIGN PATENT DOCUMENTS

| | | | |
|---|---|---|---|
| DE | EP 1764108 A1 * | 3/2007 | ............. A61K 39/39 |
| WO | WO 98/39352 | 9/1998 | |

(Continued)

OTHER PUBLICATIONS

*Homo sapiens* ubiquitin protein ligase E3A (human papilloma virus E6-associated protein, Angelman syndrome) (UBE3A), mRNA, GenBank NM_000462.1, Jan. 11, 2011, accessed and retrieved from www.ncbi.nlm.nih.gov on May 23, 2016.*
Church et al., "Lineage-specific biology revealed by a finished genome assembly of the mouse" PLoS Biol. (2009) 7: e1000112.
King et al., "Topoisomerases facilitate transcription of long genes linked to autism" Nature (2013) 501: 58-62.
Plagge "Non-Coding RNAs at the Gnas and Snrpn-Ube3a Imprinted Gene Loci and Their Involvement in Hereditary Disorders" Front Genet. (2012) 3: 1-6.
Powell et al., "R-loop formation at Snord116 mediates topotecan inhibition of Ube3a-antisense and allele-specific chromatin decondensation" Proc Natl Acad Sci (2013) 110: 13938-43.

(Continued)

*Primary Examiner* — Dana Shin
(74) *Attorney, Agent, or Firm* — Ionis Pharmaceuticals, Inc. Patent Dept.

(57) ABSTRACT

Certain embodiments are directed to methods and compounds for inhibiting UBE3A-ATS, the endogenous antisense transcript of ubiquitin protein ligase E3A (UBE3A). Such methods and compounds are useful for inducing expression of paternal UBE3A in cells and animals.

16 Claims, 2 Drawing Sheets

(56) References Cited

U.S. PATENT DOCUMENTS

| | | | |
|---|---|---|---|
| 6,525,191 B1 | 2/2003 | Ramasamy | |
| 6,582,908 B2 | 6/2003 | Fodor et al. | |
| 6,600,032 B1 | 7/2003 | Manoharan et al. | |
| 6,617,162 B2* | 9/2003 | Dobie | C12N 15/1138 435/325 |
| 6,670,461 B1 | 12/2003 | Nielsen et al. | |
| 6,770,748 B2 | 8/2004 | Imanishi et al. | |
| 6,794,499 B2 | 9/2004 | Wengel et al. | |
| 7,034,133 B2 | 4/2006 | Wengel et al. | |
| 7,053,207 B2 | 5/2006 | Wengel | |
| 7,399,845 B2 | 7/2008 | Seth et al. | |
| 7,427,672 B2 | 9/2008 | Imanishi et al. | |
| 7,547,684 B2 | 6/2009 | Seth et al. | |
| 7,696,345 B2 | 4/2010 | Allerson et al. | |
| 2001/0053519 A1 | 12/2001 | Fodor et al. | |
| 2003/0087855 A1* | 5/2003 | Ward | C12N 15/1137 514/44 A |
| 2003/0228597 A1 | 12/2003 | Cowsert et al. | |
| 2004/0171570 A1 | 9/2004 | Allerson et al. | |
| 2005/0130923 A1 | 6/2005 | Bhat et al. | |
| 2007/0031844 A1 | 2/2007 | Khvorova et al. | |
| 2008/0039618 A1 | 2/2008 | Allerson et al. | |
| 2008/0108583 A1* | 5/2008 | Feinstein | A61K 31/7088 514/44 A |
| 2009/0012281 A1 | 1/2009 | Swayze et al. | |
| 2013/0225659 A1 | 8/2013 | Bennett et al. | |
| 2014/0315992 A1 | 10/2014 | Hakonarson et al. | |

FOREIGN PATENT DOCUMENTS

| | | |
|---|---|---|
| WO | WO 99/14226 | 3/1999 |
| WO | WO 00/63364 | 10/2000 |
| WO | WO 01/49687 | 7/2001 |
| WO | WO 01/92582 | 12/2001 |
| WO | WO 2003/004602 | 1/2003 |
| WO | WO 2004/035765 | 10/2003 |
| WO | WO 2004016754 A2 * | 2/2004 ......... C12N 15/1138 |
| WO | WO 2004/106356 | 12/2004 |
| WO | WO 2005/021570 | 3/2005 |
| WO | WO 2005/121371 | 12/2005 |
| WO | WO 2006/047842 | 5/2006 |
| WO | WO 2007/134181 | 11/2007 |
| WO | WO 2008/101157 | 8/2008 |
| WO | WO 2008/150729 | 12/2008 |
| WO | WO 2008/154401 | 12/2008 |
| WO | WO 2009/006478 | 1/2009 |
| WO | WO 2009/067647 | 5/2009 |
| WO | WO 2009/100320 | 8/2009 |
| WO | WO 2010/036696 | 4/2010 |
| WO | WO 2010/036698 | 4/2010 |
| WO | WO 2011/017521 | 2/2011 |
| WO | WO 2011/109398 | 9/2011 |
| WO | WO 2011/139702 | 11/2011 |
| WO | WO 2012/012467 | 1/2012 |
| WO | WO 2012/064806 | 5/2012 |
| WO | WO 2013/033230 | 3/2013 |

OTHER PUBLICATIONS

Runte et al., "The IC-SNURF-SNRPN Transcript serves as a Host for Multiple Small Nucleolar RNA Species and as an Antisense RNA for UBE3A" Human Molecular Genetics (2001) 10: 2687-2700.
International Search Report for application PCT/US2013/47701 dated Feb. 14, 2014, 21 pages.
International Search Report for application PCT/US2015/062622 dated Jan. 15, 2016, 14 pages.
Albaek et al., "Analogues of a Locked Nucleic Acid with Three-Carbon 2',4'-Linkages: Synthesis by Ring-Closing Metathesis and Influence of Nucleic Acid Duplex Stability" J. Org. Chem. (2006) 71:7731-7740.
Allshire, "Molecular biology. RNAi and heterochromatin—a hushed-up affair" Science (2002) 297(5588):1818-1819.
Altmann et al., "Second Generation Antisense Oligonucleotides—Inhibition of PKC-α and c-raf Kinase Expression by Chimeric Oligonucleotides Incorporating 6"-Substituted Carbocyclic Nucleosides and 2"-O-Ethylene Glycol Substituted Ribonucleosides" Nuclewsodies Nucleotides. (1997) 16:917-926.
Altmann et al., "Second Generation of Antisense Oligonucleotides: From Nuclease Resistance to Biological Efficacy in Animals " Chimia. (1996) 50(4):168-176.
Altmann et al., "Second-generation antisense oligonucleotides: structure—activity relationships and the design of improved signal-transduction inhibitors" Biochem. Soc. Trans. (1996) 24:630-637.
Altschul et al., "Basic Local Alignment Search Tool" J. Mol. Biol. (1990) 215:403-410.
Baker et al., "2'-O-(2 Methoxy)ethyl-modified Anti-intercellular Adhesion Molecule 1 (ICAM-1) Oligonucleotides Selectively Increase the ICAM-1 mRNA Level and Inhibit Formation of the ICAM-1 Translation Initiation Complex in Human Umbilical Vein Endothelial Cells" J. Biol. Chem. (1997) 272:11994-12000.
Braasch et al., "Locked nucleic acid (LNA): fine-tuning the recognition of DNA and RNA" Chem. Biol. (2001) 8:1-7.
Braasch et al., "Novel antisense and peptide nucleic acid strategies for controlling gene expression" Biochemistry (2002) 41(14):4503-4510.
Branch et al., "A good antisense molecule is hard to find," TIBS (1998) 23:45-50.
Cattanach et al., "A candidate model for Angelman syndrome in the mouse" Mamm. Genome (1997) 8(7):472-478.
Chen et al., "Motor coordination deficits in Alpk1 mutant mice with the inserted piggyBac transposon" BMC Neruosci. (2011) 12:1.
Chin "On the Preparation and Utilization of Isolated and Purified Oligonucleotides" Document purportedly located on a CD-ROM and contributed to the public collection of the Katherine R. Everett Law Library of the University of North Carolina on Mar. 14, 2002.
Clark et al., "Purkinje cell expression of a mutant allele of SCA1 in transgenic mice leads to disparate effects on motor behaviors, followed by a progressive cerebellar dysfunction and histological alterations" J. Neurosci. (1997) 17(19):7385-7395.
Crooke et al., "Basic Principles of Antisense Therapeutics" Antisense Research and Application (1998) Chapter 1:1-50.
Crooke et al., "Pharmacokinetic Properties of Several Novel Oligonucleotide Analogs in mice" J. Pharmacol. Exp. Ther. (1996) 277(2):923-937.
Dindot et al., "The Angelman syndrome ubiquitin ligase localizes to the synapse and nucleus, and maternal deficiency results in abnormal dendritic spine morphology" Hum. Mol. Genet. (2008) 17(1):111-118.
Elayadi et al., "Application of PNA and LNA oligomers to chemotherapy" Curr. Opinion Invens. Drugs (2001) 2:558-561.
Faghihi et al., "RNAi screen indicates widespread biological function for human natural antisense transcripts" PLoS One (2010) 5(10):e13177.
Freier et al., "The ups and downs of nucleic acid duplex stability: structure-stability studies on chemically-modified DNA:RNA duplexes" Nucleic Acids Research (1997) 25(22):4429-4443.
Frieden et al., "Expanding the design horizon of antisense oligonucleotides with alpha-L-LNA" Nucleic Acids Research (2003) 31(21):6365-6372.
Gautschi et al., "Activity of a novel bc1-2/bc1-xLbispecific antisense oligonucleotide against tumors of diverse histologic origins" J. Natl. Cancer Inst. (2001) 93:463-471.
Gu et al., "Base pairing properties of D- and L-cyclohexene nucleic acids (CeNA)" Oligonucleotides (2003) 13(6):479-489.
Gu et al., "Enzymatic resolution and base pairing properties of D- and L-cyclohexenyl nucleic acids (CeNA)" Nucleosides Nucleotides Nucleic Acids (2005) 24(5-7):993-998.
Gu et al., "Synthesis of enantiomeric-pure cyclohexenyl nucleoside building blocks for oligonucleotide synthesis" Tetrahedron (2004) 60(9):2111-2123.
Hall et al., "Establishment and maintenance of a heterochromatin domain" Science (2002) 297(5590):2232-2237.
Hawkins et al., "Transcriptional regulation of Oct4 by a long non-coding Rna antisense to Oct4-pseudogene 5" Transcription (2010) 1(3):165-175.

(56) References Cited

OTHER PUBLICATIONS

Horvath et al., "Stereoselective synthesis of (-)-ara-cyclohexenyl-adenine" Tetrahedron Letters (2007) 48:3621-3623.

Huang et al., "Topoisomerase inhibitors unsilence the dormant allele of Ube3a in neurons" Nature (2011) 481(3780): 185-189.

Jenuwein, "Molecular biology. An RNA-guided pathway for the epigenome" Science (2002) 297(5590):2215-2218.

Hang et al., "Mutation of the Angelman ubiquitin ligase in mice causes increased cytoplasmic p53 and deficits of contextual learning and long-term potentiation" Neruon (1998) 21(4):799-811.

Kabanov et al., "A new class of antivirals: antisense oligonucleotides combined with a hydrophobic substituent effectively inhibit influenza virus reproduction and synthesis of virus-specific proteins in MDCK cells" FEBS Lett. (1990) 259:327-330.

Koshkin et al., "LNA (locked nucleic acids): Synthesis of the adenine, cytosine, guanine, 5-methylcytosine, thymine and uracil bicyclonucleoside monomers, oligomerisation, and unprecedented nucleic acid recognition" Tetrahedron (1998) 54:3607-3630.

Kumar et al., "The first analogues of LNA (locked nucleic acids): phosphorothioate-LNA and 2'-thio-LNA" Bioorg Med Chem Lett. (1998) 8:2219-2222.

Letsinger et al., "Cholesteryl-conjugated oligonucleotides: Synthesis, properties, and activity as inhibitors of replication of human immunodeficiency virus in cell culture" PNAS (1989) 86:6553-6556.

Leumann et al., "DNA Analogues: From Supramolecular Principles to Biological Properties" Bioorganic & Medicinal Chemistry (2002) 10:841-854.

Maher et al., "Comparative hybrid arrest by tandem antisense oligodeoxyribonucleotides or oligodeoxyribonucleoside methylpbosphonates in a cell-free system" Nucl. Acid. Res. (1988) 16(8):3341-3358.

Manoharan et al., "Chemical Modifications to Improve Uptake and Bioavailability of Antisense Oligonucleotides" Ann. N.Y. Acad. Sci. (1992) 660: 306-309.

Manoharan et al., "Cholic Acid-Oligonucleotide Conjugates for Antisense Applications" Bioorg. Med. Chem. Lett. (1994) 4:1053-1060.

Manoharan et al., "Introduction of a Lipophilic Thioether Tether in the Minor Groove of Nucleic Acids for Antisense Applications" Bioorg. Med. Chem. Lett. (1993) 3(12):2765-2770.

Manoharan et al., "Lipidic Nucleic Acids" Tetrahedron Lett. (1995) 36(21):3651-3654.

Manoharan et al., "Oligonucleotide Conjugates: Alteration of the Pharmacokinetic Properties of Antisense Agents" Nucleosides & Nucleotides (1995) 14(3-5):969-973.

Martin, "New acces to 2'-O-alkylated ribonucleosides and properties of 2'-O-alkylated oligoribonucleotides" Helv. Chim. Acta. (1995) 78:486-504.

Meng et al., "Ube3a-ATS is an atypical RNA polymerase II transcript that represses the paternal expression of Ube3a" Hum. Mol. Genet. (2012) 21(13):3001-3012.

Miller et al., "Phenotypic characterization of a genetically diverse panel of mice for behavioral despair and anxiety" PLoS One (2010) 5(12):e14458.

Mishra et al., "Improved leishmanicidal effect of phosphorotioate antisense oligonucleotides by LDL-mediated delivery" Biochim. Biophys. Acta (1995) 1264:229-237.

Modarresi et al., "Inhibition of natural antisense transcripts in vivo results in gene-specific transcriptional upregulation" Nat. Biotechnol. (2012) 30(5):453-459.

Morris et al., "Bidirectional transcription directs both transcriptional gene activation and suppression in human cells" PLoS Genet. (2008) 4(11):e1000258.

Nauwelaerts et al., "Cyclohexenyl nucleic acids: conformationally flexible oligonucleotides" Nucleic Acids Res. (2005) 33(8):2452-2463.

Nauwelaerts et al., "Structural characterization and biological evaluation of small interfering RNAs containing cyclohexenyl nucleosides" J. Am. Chem. Soc. (2007) 129(30):9340-9348.

New England Biolabs 1998/99 Catalog (cover page and pp. 121 and 284).

Njung'e et al., "Evaluation of marble-burying behavior as a model of anxiety" Pharmacol. Biochem. Behav. (1991) 38(1):63-67.

Oberhauser et al., "Effective incorporation of 2'-0-methyl-oligoribonucleotides into liposomes and enhanced cell association through modifications with thiocholesterol" Nucl. Acids Res. (1992) 20(3):533-538.

Orum et al., "Locked nucleic acids: A promising molecular family for gene-function analysis and antisense drug development" Curr. Opinion Mol. Ther. (2001) 3:239-243.

Pal-Bhadra et al., "Heterochromatic silencing and HP1 localization in Drosophila are dependent on the RNAi machinery" Science (2004) 303(5658):669-672.

Reynolds et al., "Rational siRNA design for RNA interference" Nature Biotechnology (2004) 22(3):326-330.

Robeyns et al., "Oligonucleotides with cyclohexene-nucleoside building blocks: crystallization and preliminary X-ray studies of a left-handed sequence GTGTACAC" Acta. Crystallogr. Sect. F. Struct. Biol. Cryst. Commun. (2005) 61(Pt 6):585-586.

Robeyns et al., "Structure of the fully modified left-handed cyclohexene nucleic acid sequence GTGTACAC" J. Am. Chem. Soc. (2008) 130(6):1979-1984.

Sahoo et al., "Prader-Willi phenotype caused by paternal deficiency for the HBII-85 C/D box small nucleolar RNA cluster" Nat. Genet. (2008) 40(6):719-721.

Saison-Behmoaras et al., "Short modified antisense oligonucleotides directed against Ha-ras point mutation induce selective cleavage of the mRNA and inhibit T24 cells proliferation" EMBO J. (1991) 10(5):1111-1118.

Sanghvi et al., "Heterocyclic Base Modifications in Nucleic Acids and Their Applications in Antisense Oligonucleotides" Antisense Research and Applications (1993) pp. 273-288.

Shea et al., "Synthesis, hybridization properties and antiviral activity of lipid-oligodeoxynucleotide conjugates" Nucl. Acids Res. (1990) 18(13):3777-3783.

Singh et al., "LNA (locked nucleic acids): synthesis and high-affinity nucleic acid recognition" Chem. Commun. (1998) 455-456.

Singh et al., "Synthesis of 2'-amino-LNA: A novel conformationally restricted high-affinity oligonucleotide analogue with a handle" J. Org. Chem. (1998) 63: 10035-10039.

Smith et al., "Comparison of biosequences" Adv. Appl. Math. (1981) 2(4):482-489.

Srivastava et al., "Five- and Six-Membered Conformationally Locked 2',4'-Carbocyclic riboThymidines: Synthesis, Structure, and Biochemical Studies" J. Am. Chem. Soc. (2007) 129(26):8362-8379.

Svinarchuk et al., "Inhibition of HIV proliferation in MT-4 cells by antisense oligonucleotide conjugated to lipophilic groups" Biochimie (1993) 75:49-54.

Tsai et al., "Paternal deletion from Snrpn to Ube3a in the mouse causes hypotonia, growth retardation and partial lethality and provides evidence for a gene contributing to Prader-Willi syndrome" Hum. Mol. Genet. (1999) 8(8):1357-1364.

Verbeure et al., "RNase H mediated cleavage of RNA by cyclohexene nucleic acid (CeNA)" Nucleic Acids Res. (2001) 29(24):4941-4947.

Verdel et al., "RNAi-mediated targeting of heterochromatin by the RITS complex" Science (2004) 303(5668):672-676.

Volpe et al., "Regulation of heterochromatic silencing and histone H3 lysine-9 methylation by RNAi" Science (2002) 297(5588):1833:1837.

Wahlestedt et al., "Potent and nontoxic antisense oligonucleotide containing locked nucleic acids" Proc. Natl. Acad. Sci. USA (2000) 97: 5633-5638.

Wang et al., "A straightforward stereoselective synthesis of D- and L-5-hydroxy-4-hydroxymethyl-2- cyclohexenylguanine" J. Org. Chem. (2001) 66(25):8478-8482.

Wang et al., "Cyclohexene nucleic acids (CeNA) form stable duplexes with RNA and induce RNase H activity" Nucleosides Nucleotides Nucleic Acids (2001) 20(4-7):785-788.

(56) References Cited

OTHER PUBLICATIONS

Wang et al., "Cyclohexene Nucleic Acids (CeNA): Serum Stable Oligonucleotides that Activate RNase H and Increase Duplex Stability with Complementary RNA" J. Am. Chem. Soc. (2000) 122(36):8595-8602.

Wang et al., "Stereocontrolled synthesis of ara-type cyclohexenyl nucleosides" J. Org. Chem. (2003) 68(11):4499-4505.

Williams et al., "Clinical and genetic aspects of Angelman syndrome" Genet. Med. (2010) 12(7):385-395.

Woolf et al., "Specificity of antisense oligonucleotides in vivo" Proc. Natl. Acad. Sci. (1992) 89(16):7305-7309.

Zhang et al., "PowerBLAST: A New Network BLAST Application for Interactive or Automated Sequence Analysis and Annotation" Genome Res. (1997) 7:649-656.

Zhou et al., "Fine Tuning of Electrostatics around the Internucleotidic Phosphate through Incorporation of Modified 2',4'-Carbocyclic-LNAs and -ENAs Leads to Significant Modulation of Antisense Properties" J. Org. Chem. (2009) 74:118-134.

Meng et al., "Towards a therapy for Angelman syndrome by targeting a long non-coding RNA" Nature (2015) 518:409-412.

Beaudet et al., "Angelman syndrome: Drugs to awaken a paternal gene," Nature (2011) 481: 150-152.

Meng et al.,"Truncation of Ube3a-ATS Unsilences Paternal UBE3a and Ameliorates Behavioral Defects in the Angelman Syndrome Mouse Model" PLOS Genetics (2013) 9:e1004039.

International Search report for application EP 2864479 dated May 10, 2016.

\* cited by examiner

MODULATION OF UBE3A-ATS EXPRESSION

CROSS REFERENCED TO RELATED APPLICATIONS

This application is a U.S. National Phase filing under 35 U.S.C. §371 claiming priority to International Serial No. PCT/US2013/047701 filed Jun. 25, 2013, which claims priority to U.S. Provisional Application 61/772,925, filed Mar. 5, 2013, U.S. Provisional Application 61/755,617, filed Jan. 23, 2013, U.S. Provisional Application 61/750,939, filed Jan. 10, 2013, U.S. Provisional Application 61/738,959, filed Dec. 18, 2012, and U.S. Provisional Application 61/664,083, filed Jun. 25, 2012, each of which is incorporated herein by reference in its entirety.

STATEMENT OF GOVERNMENT SUPPORT

This invention was made with government support under R01HD037283 awarded by National Institute of Health. The government has certain rights in the invention.

SEQUENCE LISTING

The present application is being filed along with a Sequence Listing in electronic format. The Sequence Listing is provided as a file entitled BIOL0204USASEQ_ST25.txt created Dec. 17, 2014 which is approximately 2.75 MB in size. The information in the electronic format of the sequence listing is incorporated herein by reference in its entirety.

FIELD

Certain embodiments are directed to methods and compounds for inhibiting UBE3A-ATS, the endogenous antisense transcript of ubiquitin protein ligase E3A (UBE3A). Such methods and compounds are useful for inducing expression of paternal UBE3A in cells and animals.

BACKGROUND

UBE3A is maternally expressed in neurons and encodes an E3 ubiquitin ligase named E6-AP. An endogenous antisense transcript of UBE3A, termed UBE3A-ATS, has been identified in humans and mice. UBE3A-ATS functions to suppress paternal Ube3a expression. (Meng et al., Hum Mol Genet. 21:3001-12, 2012).

Angelman syndrome (AS) is a neurodevelopmental disorder mostly attributed to deficiency of maternal UBE3A at 15q11.2, whereas paternal UBE3A is subject to genomic imprinting and silencing in neurons. Patients of Angelman syndrome suffer from developmental delay, speech impairment and seizures. Therapies for Angelman syndrome are limited and mainly focus on symptomatic management. (Williams, C. A. et al., Genet. Med., 12: 385-395, 2010).

Recently, topoisomerase inhibitors currently used in cancer treatment were found to "unsilence" paternal Ube3a expression in both a neuronal culture system and mice. (Huang, H. S. et al., Nature, 481: 185-189, 2012). However, the exact mechanism of unsilencing paternal Ube3a expression remains unknown and topoisomerase inhibitors are fraught with safety concerns because they are known to be non-specific and capable of inducing DNA damage, such as single and double-strand breaks.

SUMMARY

Several embodiments provided herein relate to the discovery that antisense compounds targeting UBE3A-ATS induce paternal expression of UBE3A. Several embodiments are drawn to methods and compounds for inducing paternal expression of UBE3A using antisense compounds targeting UBE3A-ATS within an unexpected hotspot located at a region of UBE3A-ATS upstream from the region that overlaps with UBE3A. In certain embodiments, the hotspot is located between an upstream region of UBE3A-ATS that includes the sequence of at least one small nucleolar RNA (snoRNA), such as HBII-52 or MBII-52, and a downstream region of UBE3A-ATS that is complementary to UBE3A (i.e. antisense to UBE3A). Prior to the present discovery manifest in several embodiments described herein, it was uncertain whether UBE3A-ATS could be targeted successfully with antisense compounds and even more unclear where to target within UBE3A-ATS.

The discovery of a hotpot region of UBE3A-ATS described herein was unpredictable in view of several reports teaching that sense transcript expression can be upregulated by targeting antisense transcripts at regions that either overlap or do not overlap with the sense transcripts. For example, on one hand it has been shown that antisense compounds designed to a region of the natural antisense transcript BDNF-AS that overlaps with BDNF increases BDNF mRNA levels. (Madharessi et al., Nat Biotechnol. 30:453-459, 2012). Similar findings have been reported with p21 and Oct4 antisense transcripts (Morris et al., PLoS Genet. 4:e1000258, 2008, Hawkins and Morris, Transcription 1:165-175, 2010). On the other hand, it has been shown that antisense compounds targeting natural antisense transcripts at non-overlapping regions with sense transcripts can upregulate sense transcript expression. (Faghihi et al., PLoS ONE 5:e13177, 2010).

DETAILED DESCRIPTION

Figure 1:
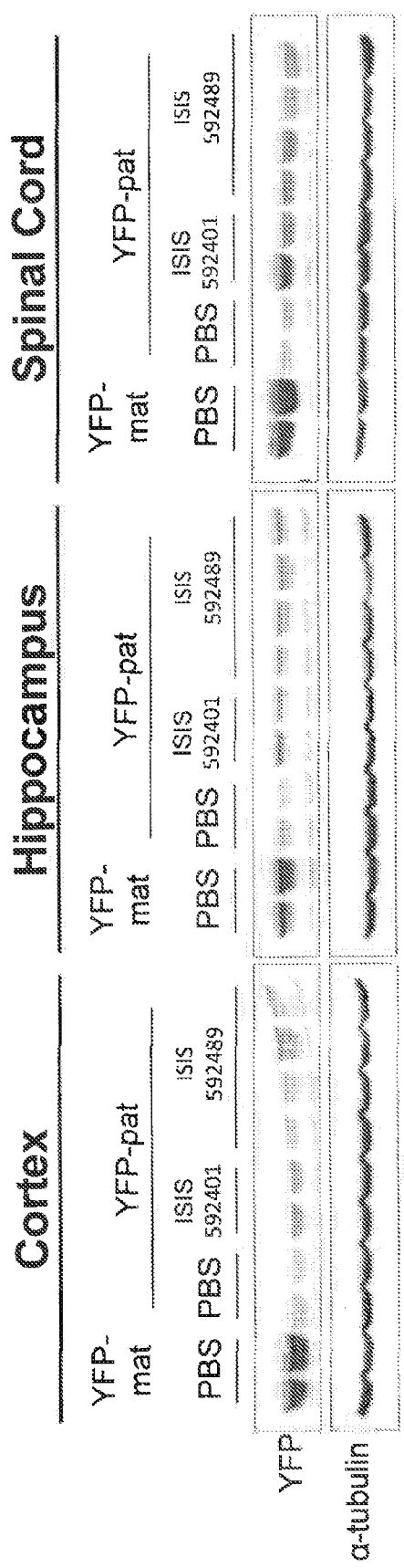
FIG. 1 shows Western Blot analysis using an anti-YFP antibody, which confirmed that treatment with ASO increased paternal Ube3a protein expression.

It is to be understood that both the foregoing general description and the following detailed description are exemplary and explanatory only and are not restrictive of the invention, as claimed. Herein, the use of the singular includes the plural unless specifically stated otherwise. As used herein, the use of "or" means "and/or" unless stated otherwise. Furthermore, the use of the term "including" as well as other forms, such as "includes" and "included", is not limiting. Also, terms such as "element" or "component" encompass both elements and components comprising one unit and elements and components that comprise more than one subunit, unless specifically stated otherwise.

The section headings used herein are for organizational purposes only and are not to be construed as limiting the subject matter described. All documents, or portions of documents, cited in this application, including, but not limited to, patents, patent applications, articles, books, and treatises, are hereby expressly incorporated by reference for the portions of the document discussed herein, as well as in their entirety.

It is understood that the sequence set forth in each SEQ ID NO described herein is independent of any modification to a sugar moiety, an internucleoside linkage, or a nucleobase.

As such, antisense compounds defined by a SEQ ID NO may comprise, independently, one or more modifications to a sugar moiety, an internucleoside linkage, or a nucleobase. Antisense compounds described by Isis Number (Isis No) indicate a combination of nucleobase sequence and motif.

Definitions

Unless specific definitions are provided, the nomenclature utilized in connection with, and the procedures and techniques of, analytical chemistry, synthetic organic chemistry, and medicinal and pharmaceutical chemistry described herein are those well known and commonly used in the art. Standard techniques may be used for chemical synthesis, and chemical analysis. Where permitted, all patents, applications, published applications and other publications, GENBANK Accession Numbers and associated sequence information obtainable through databases such as National Center for Biotechnology Information (NCBI) and other data referred to throughout in the disclosure herein are incorporated by reference for the portions of the document discussed herein, as well as in their entirety.

Unless otherwise indicated, the following terms have the following meanings:

"2'-O-methoxyethyl" (also 2'-MOE and 2'-O(CH$_2$)$_2$—OCH$_3$) refers to an O-methoxy-ethyl modification at the 2' position of a furanose ring. A 2'-O-methoxyethyl modified sugar is a modified sugar.

"2'-MOE nucleoside" (also 2'-O-methoxyethyl nucleoside) means a nucleoside comprising a 2'-MOE modified sugar moiety.

"2'-substituted nucleoside" means a nucleoside comprising a substituent at the 2'-position of the furanosyl ring other than H or OH. In certain embodiments, 2' substituted nucleosides include nucleosides with bicyclic sugar modifications.

"3' target site" refers to the nucleotide of a target nucleic acid which is complementary to the 3'-most nucleotide of a particular antisense compound.

"5' target site" refers to the nucleotide of a target nucleic acid which is complementary to the 5'-most nucleotide of a particular antisense compound.

"5-methylcytosine" means a cytosine modified with a methyl group attached to the 5 position. A 5-methylcytosine is a modified nucleobase.

"About" means within ±7% of a value. For example, if it is stated, "the compounds affected at least about 70% inhibition of UBE3A-ATS", it is implied that UBE3A-ATS levels are inhibited within a range of 63% and 77%. Similarly, if it is stated, "the compounds affected at least about 20% induction of paternal UBE3A expression", it is implied that UBE3A levels are induced by a range within 13% and 27%.

"Animal" refers to a human or non-human animal, including, but not limited to, mice, rats, rabbits, dogs, cats, pigs, and non-human primates, including, but not limited to, monkeys and chimpanzees.

"Antisense activity" means any detectable or measurable activity attributable to the hybridization of an antisense compound to its target nucleic acid. In certain embodiments, antisense activity is a decrease in the amount or expression of a target nucleic acid or protein encoded by such target nucleic acid.

"Antisense compound" means an oligomeric compound that is is capable of undergoing hybridization to a target nucleic acid through hydrogen bonding. Examples of antisense compounds include single-stranded and double-stranded compounds, such as, antisense oligonucleotides, siRNAs, shRNAs, ssRNAs, and occupancy-based compounds.

"Antisense inhibition" means reduction of target nucleic acid levels in the presence of an antisense compound complementary to a target nucleic acid compared to target nucleic acid levels in the absence of the antisense compound.

"Antisense mechanisms" are all those mechanisms involving hybridization of a compound with target nucleic acid, wherein the outcome or effect of the hybridization is either target degradation or target occupancy with concomitant stalling of the cellular machinery involving, for example, transcription or splicing.

"Antisense oligonucleotide" means a single-stranded oligonucleotide having a nucleobase sequence that permits hybridization to a corresponding region or segment of a target nucleic acid.

"Base complementarity" refers to the capacity for the precise base pairing of nucleobases of an antisense oligonucleotide with corresponding nucleobases in a target nucleic acid (i.e., hybridization), and is mediated by Watson-Crick, Hoogsteen or reversed Hoogsteen hydrogen binding between corresponding nucleobases.

"Bicyclic sugar moiety" means a modified sugar moiety comprising a 4 to 7 membered ring (including but not limited to a furanosyl) comprising a bridge connecting two atoms of the 4 to 7 membered ring to form a second ring, resulting in a bicyclic structure. In certain embodiments, the 4 to 7 membered ring is a sugar ring. In certain embodiments the 4 to 7 membered ring is a furanosyl. In certain such embodiments, the bridge connects the 2'-carbon and the 4'-carbon of the furanosyl.

"Bicyclic nucleic acid" or "BNA" or "BNA nucleosides" means nucleic acid monomers having a bridge connecting two carbon atoms between the 4' and 2'position of the nucleoside sugar unit, thereby forming a bicyclic sugar. Examples of such bicyclic sugar include, but are not limited to A) α-L-Methyleneoxy (4'-CH$_2$—O-2') LNA, (B) β-D-Methyleneoxy (4'-CH$_2$—O-2') LNA, (C) Ethyleneoxy (4'-(CH$_2$)$_2$—O-2') LNA, (D) Aminooxy (4'-CH$_2$—O—N(R)-2') LNA and (E) Oxyamino (4'-CH$_2$—N(R)—O-2') LNA, as depicted below.

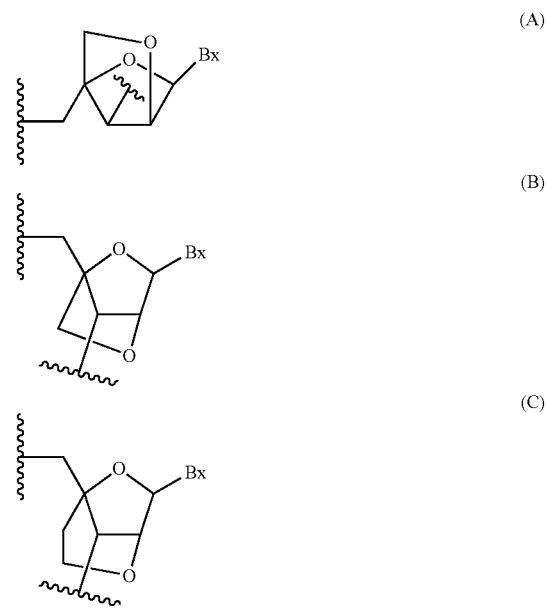

-continued

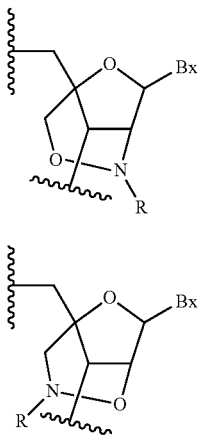

(D)

(E)

As used herein, LNA compounds include, but are not limited to, compounds having at least one bridge between the 4' and the 2' position of the sugar wherein each of the bridges independently comprises 1 or from 2 to 4 linked groups independently selected from —[C($R_1$)($R_2$)]$_n$—, —C($R_1$)=C($R_2$)—, —C($R_1$)=N—, —C(=N$R_1$)—, —C(=O)—, —C(=S)—, —O—, —Si($R_1$)$_2$—, —S(=O)$_x$— and —N($R_1$)—; wherein: x is 0, 1, or 2; n is 1, 2, 3, or 4; each $R_1$ and $R_2$ is, independently, H, a protecting group, hydroxyl, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_5$-$C_{20}$ aryl, substituted $C_5$-$C_{20}$ aryl, a heterocycle radical, a substituted heterocycle radical, heteroaryl, substituted heteroaryl, $C_5$-$C_7$ alicyclic radical, substituted $C_5$-$C_7$ alicyclic radical, halogen, O$J_1$, N$J_1J_2$, S$J_1$, $N_3$, COO$J_1$, acyl (C(=O)—H), substituted acyl, CN, sulfonyl (S(=O)$_2$-$J_1$), or sulfoxyl (S(=O)-$J_1$); and each $J_1$ and $J_2$ is, independently, H, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_5$-$C_{20}$ aryl, substituted $C_5$-$C_{20}$ aryl, acyl (C(=O)—H), substituted acyl, a heterocycle radical, a substituted heterocycle radical, $C_1$-$C_{12}$ aminoalkyl, substituted $C_1$-$C_{12}$ aminoalkyl or a protecting group.

Examples of 4'-2' bridging groups encompassed within the definition of LNA include, but are not limited to one of formulae: —[C($R_1$)($R_2$)]$_n$—, —[C($R_1$)($R_2$)]$_n$—O—, —C($R_1R_2$)—N($R_1$)—O— or —C($R_1R_2$)—O—N($R_1$)—. Furthermore, other bridging groups encompassed with the definition of LNA are 4'-$CH_2$-2', 4'-($CH_2$)$_2$-2', 4'-($CH_2$)$_3$-2', 4'-$CH_2$—O-2', 4'-($CH_2$)$_2$—O-2', 4'-$CH_2$—O—N($R_1$)-2' and 4'-$CH_2$—N($R_1$)—O-2'- bridges, wherein each $R_1$ and $R_2$ is, independently, H, a protecting group or $C_1$-$C_{12}$ alkyl.

Also included within the definition of LNA according to the invention are LNAs in which the 2'-hydroxyl group of the ribosyl sugar ring is connected to the 4' carbon atom of the sugar ring, thereby forming a methyleneoxy (4'-$CH_2$—O-2') bridge to form the bicyclic sugar moiety. The bridge can also be a methylene (—$CH_2$—) group connecting the 2' oxygen atom and the 4' carbon atom, for which the term methyleneoxy (4'-$CH_2$—O-2') LNA is used. Furthermore; in the case of the bicyclic sugar moiety having an ethylene bridging group in this position, the term ethyleneoxy (4'-$CH_2CH_2$—O-2') LNA is used. α-L-methyleneoxy (4'-$CH_2$—O-2'), an isomer of methyleneoxy (4'-$CH_2$—O-2') LNA is also encompassed within the definition of LNA, as used herein.

"Cap structure" or "terminal cap moiety" means chemical modifications, which have been incorporated at either terminus of an antisense compound.

"cEt" or "constrained ethyl" means a bicyclic sugar moiety comprising a bridge connecting the 4'-carbon and the 2'-carbon, wherein the bridge has the formula: 4'-CH($CH_3$)—O-2'.

"Constrained ethyl nucleoside" (also cEt nucleoside) means a nucleoside comprising a bicyclic sugar moiety comprising a 4'-CH($CH_3$)—O-2' bridge.

"Chemically distinct region" refers to a region of an antisense compound that is in some way chemically different than another region of the same antisense compound. For example, a region having 2'-O-methoxyethyl nucleotides is chemically distinct from a region having nucleotides without 2'-O-methoxyethyl modifications.

"Chimeric antisense compounds" means antisense compounds that have at least 2 chemically distinct regions, each position having a plurality of subunits.

"Complementarity" means the capacity for pairing between nucleobases of a first nucleic acid and a second nucleic acid.

"Comply" means the adherence with a recommended therapy by an individual.

"Comprise," "comprises" and "comprising" will be understood to imply the inclusion of a stated step or element or group of steps or elements but not the exclusion of any other step or element or group of steps or elements.

"Contiguous nucleobases" means nucleobases immediately adjacent to each other.

"Deoxyribonucleotide" means a nucleotide having a hydrogen at the 2' position of the sugar portion of the nucleotide. Deoxyribonucleotides may be modified with any of a variety of substituents.

"Designing" or "Designed to" refer to the process of designing an oligomeric compound that specifically hybridizes with a selected nucleic acid molecule.

"Efficacy" means the ability to produce a desired effect.

"Expression" includes all the functions by which a gene's coded information is converted into structures present and operating in a cell. Such structures include, but are not limited to the products of transcription and translation.

"Fully complementary" or "100% complementary" means each nucleobase of a first nucleic acid has a complementary nucleobase in a second nucleic acid. In certain embodiments, a first nucleic acid is an antisense compound and a target nucleic acid is a second nucleic acid.

"Fully modified motif" refers to an antisense compound comprising a contiguous sequence of nucleosides wherein essentially each nucleoside is a sugar modified nucleoside having uniform modification.

"Gapmer" means a chimeric antisense compound in which an internal region having a plurality of nucleosides that support RNase H cleavage is positioned between external regions having one or more nucleosides, wherein the nucleosides comprising the internal region are chemically distinct from the nucleoside or nucleosides comprising the external regions. The internal region may be referred to as the "gap" and the external regions may be referred to as the "wings."

"Gap-widened" means an antisense compound having a gap segment of 12 or more contiguous 2'-deoxyribonucleotides positioned between 5' and 3' wing segments having from one to six nucleotides having modified sugar moieties.

"Hybridization" means the annealing of complementary nucleic acid molecules. In certain embodiments, complementary nucleic acid molecules include, but are not limited to, an antisense compound and a nucleic acid target. In certain embodiments, complementary nucleic acid molecules include, but are not limited to, an antisense oligonucleotide and a nucleic acid target.

"Immediately adjacent" means there are no intervening elements between the immediately adjacent elements.

"Individual" means a human or non-human animal selected for treatment or therapy.

"Induce", "inhibit", "potentiate", "elevate", "increase", "decrease", upregulate", "downregulate", or the like, generally denote quantitative differences between two states.

"Inhibiting the expression or activity" refers to a reduction, blockade of the expression or activity and does not necessarily indicate a total elimination of expression or activity.

"Internucleoside linkage" refers to the chemical bond between nucleosides.

"Lengthened" antisense oligonucleotides are those that have one or more additional nucleosides relative to an antisense oligonucleotide disclosed herein.

"Linked deoxynucleoside" means a nucleic acid base (A, G, C, T, U) substituted by deoxyribose linked by a phosphate ester to form a nucleotide.

"Linked nucleosides" means adjacent nucleosides linked together by an internucleoside linkage.

"Mismatch" or "non-complementary nucleobase" refers to the case when a nucleobase of a first nucleic acid is not capable of pairing with the corresponding nucleobase of a second or target nucleic acid.

"Modified internucleoside linkage" refers to a substitution or any change from a naturally occurring internucleoside bond (i.e. a phosphodiester internucleoside bond).

"Modified nucleobase" means any nucleobase other than adenine, cytosine, guanine, thymidine, or uracil. An "unmodified nucleobase" means the purine bases adenine (A) and guanine (G), and the pyrimidine bases thymine (T), cytosine (C) and uracil (U).

"Modified nucleoside" means a nucleoside having, independently, a modified sugar moiety and/or modified nucleobase.

"Modified nucleotide" means a nucleotide having, independently, a modified sugar moiety, modified internucleoside linkage, or modified nucleobase.

"Modified oligonucleotide" means an oligonucleotide comprising at least one modified internucleoside linkage, a modified sugar, and/or a modified nucleobase.

"Modified sugar" means substitution and/or any change from a natural sugar moiety.

"Monomer" refers to a single unit of an oligomer. Monomers include, but are not limited to, nucleosides and nucleotides, whether naturally occurring or modified.

"Motif" means the pattern of unmodified and modified nucleosides in an antisense compound.

"Natural sugar moiety" means a sugar moiety found in DNA (2'-H) or RNA (2'-OH).

"Naturally occurring internucleoside linkage" means a 3' to 5' phosphodiester linkage.

"Non-complementary nucleobase" refers to a pair of nucleobases that do not form hydrogen bonds with one another or otherwise support hybridization.

"Nucleic acid" refers to molecules composed of monomeric nucleotides. A nucleic acid includes, but is not limited to, ribonucleic acids (RNA), deoxyribonucleic acids (DNA), single-stranded nucleic acids, double-stranded nucleic acids, small interfering ribonucleic acids (siRNA), and microRNAs (miRNA).

"Nucleobase" means a heterocyclic moiety capable of pairing with a base of another nucleic acid.

"Nucleobase complementarity" refers to a nucleobase that is capable of base pairing with another nucleobase. For example, in DNA, adenine (A) is complementary to thymine (T). For example, in RNA, adenine (A) is complementary to uracil (U). In certain embodiments, complementary nucleobase refers to a nucleobase of an antisense compound that is capable of base pairing with a nucleobase of its target nucleic acid. For example, if a nucleobase at a certain position of an antisense compound is capable of hydrogen bonding with a nucleobase at a certain position of a target nucleic acid, then the position of hydrogen bonding between the oligonucleotide and the target nucleic acid is considered to be complementary at that nucleobase pair.

"Nucleobase sequence" means the order of contiguous nucleobases independent of any sugar, linkage, and/or nucleobase modification.

"Nucleoside" means a nucleobase linked to a sugar.

"Nucleoside mimetic" includes those structures used to replace the sugar or the sugar and the base and not necessarily the linkage at one or more positions of an oligomeric compound such as for example nucleoside mimetics having morpholino, cyclohexenyl, cyclohexyl, tetrahydropyranyl, bicyclo or tricyclo sugar mimetics, e.g., non furanose sugar units. Nucleotide mimetic includes those structures used to replace the nucleoside and the linkage at one or more positions of an oligomeric compound such as for example peptide nucleic acids or morpholinos (morpholinos linked by —N(H)—C(=O)—O— or other non-phosphodiester linkage). Sugar surrogate overlaps with the slightly broader term nucleoside mimetic but is intended to indicate replacement of the sugar unit (furanose ring) only. The tetrahydropyranyl rings provided herein are illustrative of an example of a sugar surrogate wherein the furanose sugar group has been replaced with a tetrahydropyranyl ring system. "Mimetic" refers to groups that are substituted for a sugar, a nucleobase, and/or internucleoside linkage. Generally, a mimetic is used in place of the sugar or sugar-internucleoside linkage combination, and the nucleobase is maintained for hybridization to a selected target.

"Nucleotide" means a nucleoside having a phosphate group covalently linked to the sugar portion of the nucleoside.

"Oligomeric compound" means a polymer of linked monomeric subunits which is capable of hybridizing to at least a region of a nucleic acid molecule.

"Oligonucleoside" means an oligonucleotide in which the internucleoside linkages do not contain a phosphorus atom.

"Oligonucleotide" means a polymer of linked nucleosides each of which can be modified or unmodified, independent one from another.

"Peptide" means a molecule formed by linking at least two amino acids by amide bonds. Without limitation, as used herein, "peptide" refers to polypeptides and proteins.

"Phosphorothioate linkage" means a linkage between nucleosides where the phosphodiester bond is modified by replacing one of the non-bridging oxygen atoms with a sulfur atom. A phosphorothioate linkage is a modified internucleoside linkage.

"Portion" means a defined number of contiguous (i.e., linked) nucleobases of a nucleic acid. In certain embodiments, a portion is a defined number of contiguous nucleobases of a target nucleic acid. In certain embodiments, a portion is a defined number of contiguous nucleobases of an antisense compound "Region" is defined as a portion of the target nucleic acid having at least one identifiable structure, function, or characteristic.

"Ribonucleotide" means a nucleotide having a hydroxy at the 2' position of the sugar portion of the nucleotide. Ribonucleotides may be modified with any of a variety of substituents.

"Segments" are defined as smaller or sub-portions of regions within a target nucleic acid.

"Sites," as used herein, are defined as unique nucleobase positions within a target nucleic acid.

"Specifically hybridizable" refers to an antisense compound having a sufficient degree of complementarity between an antisense oligonucleotide and a target nucleic acid to induce a desired effect, while exhibiting minimal or no effects on non-target nucleic acids under conditions in which specific binding is desired, i.e., under physiological conditions in the case of in vivo assays and therapeutic treatments. "Stringent hybridization conditions" or "stringent conditions" refer to conditions under which an oligomeric compound will hybridize to its target sequence, but to a minimal number of other sequences.

"Subject" means a human or non-human animal selected for treatment or therapy.

"Target" refers to a protein, the modulation of which is desired.

"Target gene" refers to a gene encoding a target.

"Targeting" means the process of design and selection of an antisense compound that will specifically hybridize to a target nucleic acid and induce a desired effect.

"Target nucleic acid," "target RNA," "target RNA transcript" and "nucleic acid target" all mean a nucleic acid capable of being targeted by antisense compounds.

"Target region" means a portion of a target nucleic acid to which one or more antisense compounds is targeted.

"Target segment" means the sequence of nucleotides of a target nucleic acid to which an antisense compound is targeted. "5' target site" refers to the 5'-most nucleotide of a target segment. "3' target site" refers to the 3'-most nucleotide of a target segment.

"UBE3A-ATS" and "Ube3a-ATS" can be used interchangeably without capitalization of their spelling referring to any particular species or ortholog.

"UBE3A" and "Ube3A" can be used interchangeably without capitalization of their spelling referring to any particular species or ortholog. Additionally, "UBE3A", "UBE3A", "Ube3A", and "Ube3A" can be used interchangeably without italicization referring to nucleic acid or protein unless specifically indicated to the contrary.

"Unmodified" nucleobases mean the purine bases adenine (A) and guanine (G), and the pyrimidine bases thymine (T), cytosine (C) and uracil (U).

"Unmodified nucleotide" means a nucleotide composed of naturally occurring nucleobases, sugar moieties, and internucleoside linkages. In certain embodiments, an unmodified nucleotide is an RNA nucleotide (i.e. β-D-ribonucleosides) or a DNA nucleotide (i.e. β-D-deoxyribonucleoside).

"Validated target segment" is defined as at least an 8-nucleobase portion (i.e. 8 consecutive nucleobases) of a target region to which an antisense compound is targeted.

"Wing segment" means a plurality of nucleosides modified to impart to an oligonucleotide properties such as enhanced inhibitory activity, increased binding affinity for a target nucleic acid, or resistance to degradation by in vivo nucleases.

Certain Embodiments

Certain embodiments are drawn to a method of inducing expression of paternal UBE3A in a cell comprising contacting the cell with an antisense compound targeted to UBE3A-ATS. In several aspects, UBE3A-ATS comprises a nucleic acid sequence at least 85% identical to SEQ ID NO:1 or SEQ ID NO: 2.

Several embodiments provide a method of inducing expression of paternal UBE3A in a cell comprising contacting the cell with an antisense compound targeted to a region of UBE3A-ATS upstream from a region of UBE3A-ATS that is complementary to at least the 3' end of a UBE3A pre-mRNA. Several embodiments provide a method of reducing UBE3A-ATS in a cell comprising contacting the cell with an antisense compound targeted to a region of UBE3A-ATS upstream from a region of UBE3A-ATS complementary to at least the 3' end of a UBE3A pre-mRNA. In some aspects, UBE3A-ATS comprises a nucleic acid sequence at least 85% identical to SEQ ID NO: 1. In the same aspect, the region complementary to at least the 3' end of the UBE3A pre-mRNA can start at nucleobase 1032967 of SEQ ID NO: 1. In another aspect, UBE3A-ATS comprises a nucleic acid sequence at least 85% identical to SEQ ID NO: 2. In the same aspect, the region complementary to at least the 3' end of the UBE3A pre-mRNA can start at nucleobase 513603 of SEQ ID NO: 2. In certain aspects of the foregoing methods, paternal UBE3A expression is induced and/or UBE3A-ATS is reduced in the cell without reducing levels of the neighboring small nucleolar RNAs (snoRNAs) Snrpn, MBII-85/HBII-85, and/or MBII-52/HBII-52, some of are reported to be involved in Prader-Willi syndrome and are deleted in patients suffering from Prader-Willi syndrome (Sahoo, T. et al., Nat. Genet. 2008. 40: 719-21; Tsai, T. et al., Hum. Mol. Genet. 1999. 8: 1357-64).

In several aspects, contacting a cell with an antisense compound targeted to a region of UBE3A-ATS upstream from a region of UBE3A-ATS that is complementary to at least the 3' end of a UBE3A pre-mRNA induces expression of paternal UBE3A and/or reduces UBE3A-ATS in the cell without reducing Snrpn, MBII-85/HBII-85, and/or MBII-52/HBII-52 levels by more than about 0%, 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99%.

Various embodiments are directed to a method of inducing expression of paternal UBE3A in a cell comprising contacting the cell with an antisense compound targeted to a first region of UBE3A-ATS, said first region flanked by (a) an upstream region and (b) a downstream region complementary to at least the 3' end of a UBE3A pre-mRNA. Several embodiments are directed to a method of reducing UBE3A-ATS in a cell comprising contacting the cell with an antisense compound targeted to a first region of UBE3A-ATS, said first region flanked by (a) an upstream region and (b) a downstream region complementary to at least the 3' end of a UBE3A pre-mRNA. In one aspect, the upstream region comprises the sequence of at least one snoRNA. In the same aspect, the snoRNA is HBII-52 or MBII-52. In certain aspects, UBE3A-ATS comprises a nucleic acid sequence at least 85% identical to SEQ ID NO:1 and the first region of UBE3A-ATS consists of nucleobases at least 85% identical to nucleobases 997469 to 1032966 of SEQ ID NO: 1. In several aspects, the UBE3A pre-mRNA comprises a nucleic acid sequence at least 85% identical to SEQ ID NO: 5. In certain aspects, UBE3A-ATS comprises a nucleic acid sequence at least 85% identical to SEQ ID NO:2 and the first region of UBE3A-ATS consists of nucleobases at least 85% identical to nucleobases 446213 through 513602 of SEQ ID NO: 2. In several aspects, the UBE3A pre-mRNA comprises a nucleic acid sequence at least 85% identical to SEQ ID NO: 6. In certain aspects of the foregoing methods, paternal UBE3A expression is induced and/or UBE3A-ATS is reduced in the cell without reducing levels of the neighboring small nucleolar RNAs (snoRNAs) Snrpn, MBII-85/HBII-85, and/or MBII-52/HBII-52. In several aspects, contacting a cell with an antisense compound targeted to a first region of UBE3A-ATS, said first region flanked by (a) an upstream region and (b) a downstream region complementary to at least the 3' end of a UBE3A pre-mRNA, induces expression of paternal UBE3A and/or reduces UBE3A-ATS in the cell without reducing Snrpn, MBII-85/HBII-85, and/or MBII-52/HBII-52 levels by more than about 0%, 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99%.

Certain embodiments relate to a method of inducing expression of paternal UBE3A in a cell comprising contacting the cell with an antisense compound targeted to UBE3A-ATS within 35498 nucleobases upstream from the start of a region complementary to the UBE3A pre-mRNA, wherein UBE3A-ATS comprises a nucleic acid sequence at least 85% identical to the sequence of SEQ ID NO:1. Certain embodiments relate to a method of inhibiting UBE3A-ATS in a cell comprising contacting the cell with an antisense compound targeted to UBE3A-ATS within 35498 nucleobases upstream from the start of a region complementary to the UBE3A pre-mRNA, wherein UBE3A-ATS comprises a nucleic acid sequence at least 85% identical to the sequence of SEQ ID NO: 1. In one aspect, the region complementary to the UBE3A pre-mRNA consists of nucleobases 1032967 to 1110944 of SEQ ID NO:1. In certain aspects of the foregoing methods, paternal UBE3A expression is induced and/or UBE3A-ATS is reduced in the cell without reducing levels of the neighboring small nucleolar RNAs (snoRNAs) Snrpn, MBII-85/HBII-85, and/or MBII-52/HBII-52. In several aspects, contacting a cell with an antisense compound targeted to UBE3A-ATS within 35498 nucleobases upstream from the start of a region complementary to the UBE3A pre-mRNA, wherein UBE3A-ATS comprises a nucleic acid sequence at least 85% identical to the sequence of SEQ ID NO:1, induces expression of paternal UBE3A and/or reduces UBE3A-ATS in the cell without reducing Snrpn, MBII-85/HBII-85, and/or MBII-52/HBII-52 levels by more than about 0%, 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99%.

Certain embodiments relate to a method of inducing expression of paternal UBE3A in a cell comprising contacting the cell with an antisense compound targeted to UBE3A-ATS within 67390 nucleobases upstream from the start of a region complementary to the UBE3A pre-mRNA, wherein UBE3A-ATS comprises a nucleic acid sequence at least 85% identical to the sequence of SEQ ID NO: 2. Certain embodiments relate to a method of inhibiting UBE3A-ATS in a cell comprising contacting the cell with an antisense compound targeted to UBE3A-ATS within 67390 nucleobases upstream from the start of a region complementary to the UBE3A pre-mRNA, wherein UBE3A-ATS comprises a nucleic acid sequence at least 85% identical to the sequence of SEQ ID NO:2. In one aspect, the region complementary to the UBE3A pre-mRNA consists of nucleobases 513603 through 615382 of SEQ ID NO:2. In certain aspects of the foregoing methods, paternal UBE3A expression is induced and/or UBE3A-ATS is reduced in the cell without reducing levels of the neighboring small nucleolar RNAs (snoRNAs) Snrpn, MBII-85/HBII-85, and/or MBII-52/HBII-52. In several aspects, contacting a cell with an antisense compound targeted to UBE3A-ATS within 67390 nucleobases upstream from the start of a region complementary to the UBE3A pre-mRNA, wherein UBE3A-ATS comprises a nucleic acid sequence at least 85% identical to the sequence of SEQ ID NO: 2, induces expression of paternal UBE3A and/or reduces UBE3A-ATS in the cell without reducing Snrpn, MBII-85/HBII-85, and/or MBII-52/HBII-52 levels by more than about 0%, 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99%.

In several aspects of any of the foregoing embodiments, contacting the cell with the antisense compound reduces the level of UBE3A-ATS in the cell and/or induces expression of paternal UBE3A protein in the cell.

In several aspects of any of the foregoing embodiments, the cell is a cultured cell. In the same aspect, the cell is an animal.

Certain embodiments are drawn to a method of inducing expression of paternal UBE3A in an animal comprising administering to the animal an antisense compound targeted to UBE3A-ATS. In several aspects, UBE3A-ATS comprises a nucleic acid sequence at least 85% identical to SEQ ID NO:1 or SEQ ID NO: 2.

Several embodiments relate to a method of inducing expression of paternal UBE3A and/or reducing UBE3A-ATS in an animal comprising administering to the animal an antisense compound targeted to a region of UBE3A-ATS upstream from a region of UBE3A-ATS complementary to at least the 3' end of a UBE3A pre-mRNA. In some aspects, UBE3A-ATS comprises a nucleic acid sequence at least 85% identical to SEQ ID NO:1. In the same aspect, the region complementary to at least the 3' end of the UBE3A pre-mRNA can start at nucleobase 1032967 of SEQ ID NO: 1. In another aspect, UBE3A-ATS comprises a nucleic acid sequence at least 85% identical to SEQ ID NO: 2. In the same aspect, the region complementary to at least the 3' end of the UBE3A pre-mRNA can start at nucleobase 513603 of SEQ ID NO: 2. In certain aspects of the foregoing methods, paternal UBE3A expression is induced and/or UBE3A-ATS is reduced in the animal without reducing levels of the neighboring snoRNAs Snrpn, MBII-85/HBII-85, and/or MBII-52/HBII-52. In several aspects, administering an antisense compound targeted to a region of UBE3A-ATS upstream from a region of UBE3A-ATS that is complementary to at least the 3' end of a UBE3A pre-mRNA induces expression of paternal UBE3A and/or reduces UBE3A-ATS in the animal without reducing Snrpn, MBII-85/HBII-85, and/or MBII-52/HBII-52 levels by more than about 0%, 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99%.

Various embodiments are directed to a method of inducing expression of paternal UBE3A and/or reducing UBE3A-ATS in an animal comprising administering to the animal an antisense compound targeted to a first region of UBE3A-ATS, said first region flanked by (a) an upstream region and (b) a downstream region complementary to a UBE3A pre-mRNA. In one aspect, the upstream region comprises the sequence of least one small nucleolar RNA (snRNA). In the same aspect, the snoRNA is HBII-52 or MBII-52. In certain aspects, UBE3A-ATS comprises a nucleic acid sequence at least 85% identical to SEQ ID NO: 1 and the first region of UBE3A-ATS consists of nucleobases at least 85% identical to nucleobases 997469 to 1032966 of SEQ ID NO: 1. In several aspects, the UBE3A pre-mRNA comprises a nucleic acid sequence at least 85% identical to SEQ ID NO: 5. In certain aspects, UBE3A-ATS comprises a nucleic acid sequence at least 85% identical to SEQ ID NO: 2 and the first region of UBE3A-ATS consists of nucleobases at least 85% identical to nucleobases 446213 through 513602 of SEQ ID NO: 2. In several aspects, the UBE3A pre-mRNA comprises a nucleic acid sequence at least 85% identical to SEQ ID NO: 6. In certain aspects of the foregoing methods, paternal UBE3A expression is induced and/or UBE3A-ATS is reduced in the animal without reducing levels of the neighboring small nucleolar RNAs (snoRNAs) Snrpn, MBII-85/HBII-85, and/or MBII-52/HBII-52. In several aspects, administering an antisense compound targeted to a first region of UBE3A-ATS, said first region flanked by (a) an upstream region and (b) a downstream region complementary to at least the 3' end of a UBE3A pre-mRNA, induces expression of paternal UBE3A and/or reduces UBE3A-ATS in the animal without reducing Snrpn, MBII-85/HBII-85, and/or MBII-52/HBII-52 levels by more than about 0%, 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69% 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99%.

Certain embodiments provide a method of inducing expression of paternal UBE3A and/or reducing UBE3A-ATS in an animal comprising administering to the animal an antisense compound targeted to UBE3A-ATS within 35498 nucleobases upstream from the start of a region complementary to the UBE3A pre-mRNA, wherein UBE3A-ATS comprises a nucleic acid sequence at least 85% identical to the sequence of SEQ ID NO: 1. In one aspect, the region complementary to the UBE3A pre-mRNA consists of nucleobases 1032967 to 1110944 of SEQ ID NO: 1. In certain aspects of the foregoing methods, paternal UBE3A expression is induced and/or UBE3A-ATS is reduced in the animal without reducing levels of the neighboring small nucleolar RNAs (snoRNAs) Snrpn, MBII-85/HBII-85, and/or MBII-52/HBII-52. In several aspects, administering an antisense compound targeted to UBE3A-ATS within 35498 nucleobases upstream from the start of a region complementary to the UBE3A pre-mRNA, wherein UBE3A-ATS comprises a nucleic acid sequence at least 85% identical to the sequence of SEQ ID NO:1, induces expression of paternal UBE3A and/or reduces UBE3A-ATS in the animal without reducing Snrpn, MBII-85/HBII-85, and/or MBII-52/HBII-52 levels by more than about 0%, 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99%.

Various embodiments relate to a method of inducing expression of paternal UBE3A and/or reducing UBE3A-ATS in an animal comprising administering to the animal an antisense compound targeted to UBE3A-ATS within 67390 nucleobases upstream from the start of a region complementary to the UBE3A pre-mRNA, wherein UBE3A-ATS comprises a nucleic acid sequence at least 85% identical to the sequence of SEQ ID NO: 2. In one aspect, the region complementary to the UBE3A pre-mRNA consists of nucleobases 513603 through 615382 of SEQ ID NO: 2. In certain aspects of the foregoing methods, paternal UBE3A expression is induced and/or UBE3A-ATS is reduced in the animal without reducing levels of the neighboring small nucleolar RNAs (snoRNAs) Snrpn, MBII-85/HBII-85, and/or MBII-52/HBII-52. In several aspects, administering an antisense compound targeted to UBE3A-ATS within 67390 nucleobases upstream from the start of a region complementary to the UBE3A pre-mRNA, wherein UBE3A-ATS comprises a nucleic acid sequence at least 85% identical to the sequence of SEQ ID NO: 2, induces expression of paternal UBE3A and/or reduces UBE3A-ATS in the animal without reducing Snrpn, MBII-85/HBII-85, and/or MBII-52/HBII-52 levels by more than about 0%, 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52% 53%, 54% 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99%.

In any of the aforementioned embodiments and aspects thereof, the antisense compound can comprise an oligonucleotide consisting of 12 to 30 linked nucleosides, wherein the oligonucleotide is at least 85% complementary to a UBE3A-ATS nucleic acid sequence. In certain aspects, the oligonucleotide is at least 90%, at least 95%, or 100% complementary over its entire length to an equal length region of a UBE3A-ATS nucleic acid sequence. In certain aspects, the antisense compound or oligonucleotide is a single-stranded oligonucleotide. In several aspects, the oligonucleotide is a modified oligonucleotide. In the same aspect, the modified oligonucleotide can comprise at least one modified internucleoside linkage. Yet again in the same aspect, the modified internucleoside linkage can be a phosphorothioate internucleoside linkage. In several aspects, at least one nucleoside comprises a modified sugar. In the same aspect, the modified sugar is a bicyclic sugar comprising a bridge between the 4' and the 2' positions of the sugar, such as a bridge is selected from 4'-CH(CH$_3$)—O-2', 4'-CH$_2$-2', 4'-(CH$_2$)$_2$-2', 4'-CH$_2$—O-2', 4'-(CH$_2$)$_2$—O-2', 4'-CH$_2$—O—N(R$_1$)-2' and 4'-CH2-N(R$_1$)—O-2'- wherein each R1 is, independently, H, a protecting group or C1-C12 alkyl. Further in the same aspect, the bridge is 4'-CH(CH$_3$)—O-2'.

In any of the preceding embodiments and aspects thereof including a modified sugar, the modified sugar can comprise a 2'-O-methoxyethyl group.

In any of the preceding embodiments and aspects thereof including a modified oligonucleotide, at least one nucleoside can comprise a modified nucleobase, such as a 5-methylcytosine.

In any of the foregoing embodiments and aspects thereof, the antisense compound or modified oligonucleotide induces expression of paternal UBE3A by at least 20%, at least 30%, at least 40%., at least 50%, at least 60%, at least 70%, at least 80%, at least 90%, at least 100%, at least 110%, at least 120%, at least 130%, at least 140%, at least 150%, at least 160%, at least 170%, at least 180%, at least 190%, at least 200%, at least 210%, at least 220%, at least 230%, at least 240%, or at least 250%.

Certain embodiments are drawn to a method of treating an animal with an antisense compound targeted to UBE3A-ATS comprising selecting an animal in need thereof and administering to the animal an antisense compound targeted to UBE3A-ATS. In several aspects, UBE3A-ATS comprises a nucleic acid sequence at least 85% identical to SEQ ID NO: 1 or SEQ ID NO: 2.

Several embodiments are directed to a method of treating an animal with an antisense compound targeted to UBE3A-ATS comprising selecting an animal in need thereof and administering to the animal an antisense compound targeted to a region of UBE3A-ATS upstream from a region of UBE3A-ATS complementary to at least the 3' end of a UBE3A pre-mRNA. In some aspects, UBE3A-ATS comprises a nucleic acid sequence at least 85% identical to SEQ ID NO: 1. In the same aspect, the region complementary to at least the 3' end of the UBE3A pre-mRNA can start at nucleobase 1032967 of SEQ ID NO: 1. In another aspect, UBE3A-ATS comprises a nucleic acid sequence at least 85% identical to SEQ ID NO: 2. In the same aspect, the region complementary to at least the 3' end of the UBE3A pre-mRNA can start at nucleobase 513603 of SEQ ID NO: 2.

Various embodiments relate to a method of treating an animal with an antisense compound targeted to UBE3A-ATS comprising selecting an animal in need thereof and administering to the animal an antisense compound targeted to a first region of UBE3A-ATS, said first region flanked by (a) an upstream region and (b) a downstream region complementary to at least the 3' end of a UBE3A pre-mRNA. In one aspect, the upstream region comprises the sequence of at least one small nucleolar RNAs (snoRNA). In the same aspect, the snoRNA is HBII-52 or MBII-52. In certain aspects, UBE3A-ATS comprises a nucleic acid sequence at least 85% identical to SEQ ID NO: 1 and the first region of UBE3A-ATS consists of nucleobases at least 85% identical to nucleobases 997469 to 1032966 of SEQ ID NO: 1. In several aspects, the UBE3A pre-mRNA comprises a nucleic acid sequence at least 85% identical to SEQ ID NO: 5. In certain aspects, UBE3A-ATS comprises a nucleic acid sequence at least 85% identical to SEQ ID NO:2 and the first region of UBE3A-ATS consists of nucleobases at least 85% identical to nucleobases 446213 through 513602 of SEQ ID NO: 2. In several aspects, the UBE3A pre-mRNA comprises a nucleic acid sequence at least 85% identical to SEQ ID NO: 6.

Certain embodiments provide a method of treating an animal with an antisense compound targeted to UBE3A-ATS comprising selecting an animal in need thereof and administering to the animal an antisense compound targeted to UBE3A-ATS within 35498 nucleobases upstream from the start of the region complementary to a UBE3A pre-mRNA, wherein UBE3A-ATS comprises a nucleic acid sequence at least 85% identical to the sequence of SEQ ID NO: 1. In one aspect, the region complementary to the UBE3A pre-mRNA consists of nucleobases 1032967 to 1110944 of SEQ ID NO: 1.

Several embodiments relate to a method of treating an animal with an antisense compound targeted to UBE3A-ATS comprising selecting an animal in need thereof and administering to the animal an antisense compound targeted to UBE3A-ATS within 67390 nucleobases upstream from the start of a region complementary to the UBE3A pre-mRNA, wherein UBE3A-ATS comprises a nucleic acid sequence at least 85% identical to the sequence of SEQ ID NO: 2. In one aspect, the region complementary to the UBE3A pre-mRNA consists of nucleobases 513603 through 615382 of SEQ ID NO: 2.

In certain aspects of any of the foregoing embodiments drawn to a method of treating an animal, the animal has Angelman Syndrome. In certain aspects, the animal having Angelman Syndrome treated according to the methods provided herein show an improvement in anxiety, learning, balance, motor function, and/or seizures.

In certain aspects of any of the foregoing embodiments drawn to a method of treating an animal, administering an antisense compound provided treats the animal without reducing levels of the neighboring small nucleolar RNAs (snoRNAs) Snrpn, MBII-85/HBII-85, and/or MBII-52/HBII-52. In several aspects, administering an antisense compound provided herein treats the animal without reducing Snrpn, MBII-85/HBII-85, and/or MBII-52/HBII-52 levels by more than about 0%, 1%, 2%, 3%, 4%, 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99%.

Certain embodiments are drawn to an antisense compound targeted to UBE3A-ATS. In several aspects, UBE3A-

ATS comprises a nucleic acid sequence at least 85% identical to SEQ ID NO: 1 or SEQ ID NO: 2.

Several embodiments provide an antisense compound targeted to a region of UBE3A-ATS upstream from a region of UBE3A-ATS complementary to at least the 3' end of a UBE3A pre-mRNA. In some aspects, UBE3A-ATS comprises a nucleic acid sequence at least 85% identical to SEQ ID NO: 1. In the same aspect, the region complementary to at least the 3' end of the UBE3A pre-mRNA can start at nucleobase 1032967 of SEQ ID NO: 1. In another aspect, UBE3A-ATS comprises a nucleic acid sequence at least 85% identical to SEQ ID NO: 2. In the same aspect, the region complementary to at least the 3' end of the UBE3A pre-mRNA can start at nucleobase 513603 of SEQ ID NO: 2.

Various embodiments are directed to an antisense compound targeted to a first region of UBE3A-ATS, said first region flanked by (a) an upstream region and (b) a downstream region complementary to at least the 3' end of a UBE3A pre-mRNA. In one aspect, the upstream region comprises the sequence of at least one small nucleolar RNAs (snoRNA). In the same aspect, the snoRNA is HBII-52 or MBII-52. In certain aspects, UBE3A-ATS comprises a nucleic acid sequence at least 85% identical to SEQ ID NO: 1 and the first region of UBE3A-ATS consists of nucleobases at least 85% identical to nucleobases 997469 to 1032966 of SEQ ID NO: 1. In several aspects, the UBE3A pre-mRNA comprises a nucleic acid sequence at least 85% identical to SEQ ID NO: 5. In certain aspects, UBE3A-ATS comprises a nucleic acid sequence at least 85% identical to SEQ ID NO: 2 and the first region of UBE3A-ATS consists of nucleobases at least 85% identical to nucleobases 446213 through 513602 of SEQ ID NO: 2. In several aspects, the UBE3A pre-mRNA comprises a nucleic acid sequence at least 85% identical to SEQ ID NO: 6.

Certain embodiments relate to an antisense compound targeted to UBE3A-ATS within 35498 nucleobases upstream from the start of a region complementary to the UBE3A pre-mRNA, wherein UBE3A-ATS comprises a nucleic acid sequence at least 85% identical to the sequence of SEQ ID NO: 1. In one aspect, the region complementary to the UBE3A pre-mRNA consists of nucleobases 1032967 to 1110944 of SEQ ID NO: 1.

Certain embodiments relate to an antisense compound targeted to UBE3A-ATS within 67390 nucleobases upstream from the start of a region complementary to the UBE3A pre-mRNA, wherein UBE3A-ATS comprises a nucleic acid sequence at least 85% identical to the sequence of SEQ ID NO: 2. In one aspect, the region complementary to the UBE3A pre-mRNA consists of nucleobases 513603 through 615382 of SEQ ID NO: 2.

In several aspects of any of the foregoing embodiments, the antisense compound is capable of reducing the level of UBE3A-ATS in the cell and/or inducing expression of paternal UBE3A protein in the cell.

In any of the aforementioned embodiments and aspects thereof, the antisense compound can comprise an oligonucleotide consisting of 12 to 30 linked nucleosides, wherein the oligonucleotide is at least 85% complementary to a UBE3A-ATS nucleic acid sequence. In certain aspects, the oligonucleotide is at least 90%, at least 95%, or 100% complementary over its entire length to an equal length region of a UBE3A-ATS nucleic acid sequence. In certain aspects, the antisense compound or oligonucleotide is a single-stranded oligonucleotide. In several aspects, the oligonucleotide is a modified oligonucleotide. In the same aspect, the modified oligonucleotide can comprise at least one modified internucleoside linkage. Yet again in the same aspect, the modified internucleoside linkage can be a phosphorothioate internucleoside linkage. In several aspects, at least one nucleoside comprises a modified sugar. In the same aspect, the modified sugar is a bicyclic sugar comprising a bridge between the 4' and the 2' positions of the sugar, such as a bridge is selected from 4'-CH(CH$_3$)—O-2', 4'-CH$_2$-2', 4'-(CH$_2$)$_2$-2', 4'-CH$_2$—O-2', 4'-(CH$_2$)$_2$—O-2', 4'-CH$_2$—O—N(R$_1$)-2' and 4'-CH2-N(R$_1$)—O-2'- wherein each R1 is, independently, H, a protecting group or C1-C12 alkyl. Further in the same aspect, the bridge is 4'-CH(CH$_3$)—O-2'.

In any of the preceding embodiments and aspects thereof including a modified sugar, the modified sugar can comprise a 2'-O-methoxyethyl group.

In any of the preceding embodiments and aspects thereof including a modified oligonucleotide, at least one nucleoside can comprise a modified nucleobase, such as a 5-methylcytosine.

In any of the foregoing embodiments and aspects thereof, the antisense compound or modified oligonucleotide is capable of inducing expression of paternal UBE3A by at least 20%, at least 30%, at least 40%, at least 50%, at least 60%, at least 70%, at least 80%, at least 90%, at least 100%, at least 110%, at least 120%, at least 130%, at least 140%, at least 150%, at least 160%, at least 170%, at least 180%, at least 190%, at least 200%, at least 210%, at least 220%, at least 230%, at least 240%, or at least 250%.

Antisense Compounds

Oligomeric compounds include, but are not limited to, oligonucleotides, oligonucleosides, oligonucleotide analogs, oligonucleotide mimetics, antisense compounds, antisense oligonucleotides, and siRNAs. An oligomeric compound may be "antisense" to a target nucleic acid, meaning that is is capable of undergoing hybridization to a target nucleic acid through hydrogen bonding.

In certain embodiments, an antisense compound has a nucleobase sequence that, when written in the 5' to 3' direction, comprises the reverse complement of the target segment of a target nucleic acid to which it is targeted. In certain such embodiments, an antisense oligonucleotide has a nucleobase sequence that, when written in the 5' to 3' direction, comprises the reverse complement of the target segment of a target nucleic acid to which it is targeted.

In certain embodiments, an antisense compound is 10-30 subunits in length. In certain embodiments, an antisense compound is 12 to 30 subunits in length. In certain embodiments, an antisense compound is 12 to 22 subunits in length. In certain embodiments, an antisense compound is 14 to 30 subunits in length. In certain embodiments, an antisense compound is 14 to 20 subunits in length. In certain embodiments, an antisense compound is 15 to 30 subunits in length. In certain embodiments, an antisense compound is 15 to 20 subunits in length. In certain embodiments, an antisense compound is 16 to 30 subunits in length. In certain embodiments, an antisense compound is 16 to 20 subunits in length. In certain embodiments, an antisense compound is 17 to 30 subunits in length. In certain embodiments, an antisense compound is 17 to 20 subunits in length. In certain embodiments, an antisense compound is 18 to 30 subunits in length. In certain embodiments, an antisense compound is 18 to 21 subunits in length. In certain embodiments, an antisense compound is 18 to 20 subunits in length. In certain embodiments, an antisense compound is 20 to 30 subunits in length. In other words, such antisense compounds are from 12 to 30 linked subunits, 14 to 30 linked subunits, 14 to 20 subunits, 15 to 30 subunits, 15 to 20 subunits, 16 to 30 subunits, 16 to 20 subunits, 17 to 30 subunits, 17 to 20 subunits, 18 to 30 subunits, 18 to 20 subunits, 18 to 21 subunits, 20 to 30 subunits, or 12 to 22 linked subunits, respectively. In certain embodiments, an antisense compound is 14 subunits in length. In certain embodiments, an antisense compound is 16 subunits in length. In certain embodiments, an antisense compound is 17 subunits in length. In certain embodiments, an antisense compound is 18 subunits in length. In certain embodiments, an antisense compound is 20 subunits in length. In other embodiments, the antisense compound is 8 to 80, 12 to 50, 13 to 30, 13 to 50, 14 to 30, 14 to 50, 15 to 30, 15 to 50, 16 to 30, 16 to 50, 17 to 30, 17 to 50, 18 to 22, 18 to 24, 18 to 30, 18 to 50, 19 to 22, 19 to 30, 19 to 50, or 20 to 30 linked subunits. In certain such embodiments, the antisense compounds are 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, or 80 linked subunits in length, or a range defined by any two of the above values. In some embodiments the antisense compound is an antisense oligonucleotide, and the linked subunits are nucleotides.

In certain embodiments antisense oligonucleotides may be shortened or truncated. For example, a single subunit may be deleted from the 5' end (5' truncation), or alternatively from the 3' end (3' truncation). A shortened or truncated antisense compound targeted to a UBE3A-ATS nucleic acid may have two subunits deleted from the 5' end, or alternatively may have two subunits deleted from the 3' end, of the antisense compound. Alternatively, the deleted nucleosides may be dispersed throughout the antisense compound, for example, in an antisense compound having one nucleoside deleted from the 5' end and one nucleoside deleted from the 3' end.

When a single additional subunit is present in a lengthened antisense compound, the additional subunit may be located at the 5' or 3' end of the antisense compound. When two or more additional subunits are present, the added subunits may be adjacent to each other, for example, in an antisense compound having two subunits added to the 5' end (5' addition), or alternatively to the 3' end (3' addition), of the antisense compound. Alternatively, the added subunits may be dispersed throughout the antisense compound, for example, in an antisense compound having one subunit added to the 5' end and one subunit added to the 3' end.

It is possible to increase or decrease the length of an antisense compound, such as an antisense oligonucleotide, and/or introduce mismatch bases without eliminating activity. For example, in Woolf et al. (Proc. Natl. Acad. Sci. USA 89:7305-7309, 1992), a series of antisense oligonucleotides 13-25 nucleobases in length were tested for their ability to induce cleavage of a target RNA in an oocyte injection model. Antisense oligonucleotides 25 nucleobases in length with 8 or 11 mismatch bases near the ends of the antisense oligonucleotides were able to direct specific cleavage of the target mRNA, albeit to a lesser extent than the antisense oligonucleotides that contained no mismatches. Similarly, target specific cleavage was achieved using 13 nucleobase antisense oligonucleotides, including those with 1 or 3 mismatches.

Gautschi et al. (*J. Natl. Cancer Inst.* 93:463-471, March 2001) demonstrated the ability of an oligonucleotide having 100% complementarity to the bcl-2 mRNA and having 3 mismatches to the bcl-xL mRNA to reduce the expression of both bcl-2 and bcl-xL in vitro and in vivo. Furthermore, this oligonucleotide demonstrated potent anti-tumor activity in vivo.

Maher and Dolnick (*Nuc. Acid. Res.* 16:3341-3358, 1988) tested a series of tandem 14 nucleobase antisense oligonucleotides, and a 28 and 42 nucleobase antisense oligonucleotides comprised of the sequence of two or three of the tandem antisense oligonucleotides, respectively, for their ability to arrest translation of human DHFR in a rabbit reticulocyte assay. Each of the three 14 nucleobase antisense oligonucleotides alone was able to inhibit translation, albeit at a more modest level than the 28 or 42 nucleobase antisense oligonucleotides.

Certain Antisense Compound Motifs and Mechanisms

In certain embodiments, antisense compounds have chemically modified subunits arranged in patterns, or motifs, to confer to the antisense compounds properties such as enhanced inhibitory activity, increased binding affinity for a target nucleic acid, or resistance to degradation by in vivo nucleases. Chimeric antisense compounds typically contain at least one region modified so as to confer increased resistance to nuclease degradation, increased cellular uptake, increased binding affinity for the target nucleic acid, and/or increased inhibitory activity. A second region of a chimeric antisense compound may confer another desired property e.g., serve as a substrate for the cellular endonuclease RNase H, which cleaves the RNA strand of an RNA:DNA duplex.

Antisense activity may result from any mechanism involving the hybridization of the antisense compound (e.g., oligonucleotide) with a target nucleic acid, wherein the hybridization ultimately results in a biological effect. In certain embodiments, the amount and/or activity of the target nucleic acid is modulated. In certain embodiments, the amount and/or activity of the target nucleic acid is reduced. In certain embodiments, hybridization of the antisense compound to the target nucleic acid ultimately results in target nucleic acid degradation. In certain embodiments, hybridization of the antisense compound to the target nucleic acid does not result in target nucleic acid degradation. In certain such embodiments, the presence of the antisense compound hybridized with the target nucleic acid (occupancy) results in a modulation of antisense activity. In certain embodiments, antisense compounds having a particular chemical motif or pattern of chemical modifications are particularly suited to exploit one or more mechanisms. In certain embodiments, antisense compounds function through more than one mechanism and/or through mechanisms that have not been elucidated. Accordingly, the antisense compounds described herein are not limited by particular mechanism.

Antisense mechanisms include, without limitation, RNase H mediated antisense; RNAi mechanisms, which utilize the RISC pathway and include, without limitation, siRNA, ssRNA and microRNA mechanisms; and occupancy based mechanisms. Certain antisense compounds may act through more than one such mechanism and/or through additional mechanisms.

RNase H-Mediated Antisense

In certain embodiments, antisense activity results at least in part from degradation of target RNA by RNase H. RNase H is a cellular endonuclease that cleaves the RNA strand of an RNA:DNA duplex. It is known in the art that single-stranded antisense compounds which are "DNA-like" elicit RNase H activity in mammalian cells. Accordingly, antisense compounds comprising at least a portion of DNA or DNA-like nucleosides may activate RNase H, resulting in cleavage of the target nucleic acid. In certain embodiments, antisense compounds that utilize RNase H comprise one or more modified nucleosides. In certain embodiments, such antisense compounds comprise at least one block of 1-8 modified nucleosides. In certain such embodiments, the modified nucleosides do not support RNase H activity. In certain embodiments, such antisense compounds are gapmers, as described herein. In certain such embodiments, the gap of the gapmer comprises DNA nucleosides. In certain such embodiments, the gap of the gapmer comprises DNA-like nucleosides. In certain such embodiments, the gap of the gapmer comprises DNA nucleosides and DNA-like nucleosides.

Certain antisense compounds having a gapmer motif are considered chimeric antisense compounds. In a gapmer an internal region having a plurality of nucleotides that supports RNaseH cleavage is positioned between external regions having a plurality of nucleotides that are chemically distinct from the nucleosides of the internal region. In the case of an antisense oligonucleotide having a gapmer motif, the gap segment generally serves as the substrate for endonuclease cleavage, while the wing segments comprise modified nucleosides. In certain embodiments, the regions of a gapmer are differentiated by the types of sugar moieties comprising each distinct region. The types of sugar moieties that are used to differentiate the regions of a gapmer may in some embodiments include β-D-ribonucleosides, β-D-deoxyribonucleosides, 2'-modified nucleosides (such 2'-modified nucleosides may include 2'-MOE and 2'-O—CH$_3$, among others), and bicyclic sugar modified nucleosides (such bicyclic sugar modified nucleosides may include those having a constrained ethyl). In certain embodiments, nucleosides in the wings may include several modified sugar moieties, including, for example 2'-MOE and bicyclic sugar moieties such as constrained ethyl or LNA. In certain embodiments, wings may include several modified and unmodified sugar moieties. In certain embodiments, wings may include various combinations of 2'-MOE nucleosides, bicyclic sugar moieties such as constrained ethyl nucleosides or LNA nucleosides, and 2'-deoxynucleosides.

Each distinct region may comprise uniform sugar moieties, variant, or alternating sugar moieties. The wing-gap-wing motif is frequently described as "X-Y-Z", where "X" represents the length of the 5'-wing, "Y" represents the length of the gap, and "Z" represents the length of the 3'-wing. "X" and "Z" may comprise uniform, variant, or alternating sugar moieties. In certain embodiments, "X" and "Y" may include one or more 2'-deoxynucleosides. "Y" may comprise 2'-deoxynucleosides. As used herein, a gapmer described as "X-Y-Z" has a configuration such that the gap is positioned immediately adjacent to each of the 5'-wing and the 3' wing. Thus, no intervening nucleotides exist between the 5'-wing and gap, or the gap and the 3'-wing. Any of the antisense compounds described herein can have a gapmer motif. In certain embodiments, "X" and "Z" are the same; in other embodiments they are different. In certain embodiments, "Y" is between 8 and 15 nucleosides. X, Y, or Z can be any of 1, 2, 3, 4, 5, 6, 7, 8, 9, 10, 11, 12, 13, 14, 15, 16, 17, 18, 19, 20, 25, 30 or more nucleosides.

In certain embodiments, the antisense compound targeted to a UBE3A-ATS nucleic acid has a gapmer motif in which the gap consists of 6, 7, 8, 9, 10, 11, 12, 13, 14, 15, or 16 linked nucleosides.

In certain embodiments, the antisense oligonucleotide has a sugar motif described by Formula A as follows:

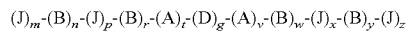

wherein:
each A is independently a 2'-substituted nucleoside;
each B is independently a bicyclic nucleoside;
each J is independently either a 2'-substituted nucleoside or a 2'-deoxynucleoside;
each D is a 2'-deoxynucleoside;
m is 0-4; n is 0-2; p is 0-2; r is 0-2; t is 0-2; v is 0-2; w is 0-4; x is 0-2; y is 0-2; z is 0-4; g is 6-14;
provided that:
at least one of m, n, and r is other than 0;
at least one of w and y is other than 0;
the sum of m, n, p, r, and t is from 2 to 5; and
the sum of v, w, x, y, and z is from 2 to 5.

RNAi Compounds

In certain embodiments, antisense compounds are interfering RNA compounds (RNAi), which include double-stranded RNA compounds (also referred to as short-interfering RNA or siRNA) and single-stranded RNAi compounds (or ssRNA). Such compounds work at least in part through the RISC pathway to degrade and/or sequester a target nucleic acid (thus, include microRNA/microRNA-mimic compounds). In certain embodiments, antisense compounds comprise modifications that make them particularly suited for such mechanisms.

i. ssRNA Compounds

In certain embodiments, antisense compounds including those particularly suited for use as single-stranded RNAi compounds (ssRNA) comprise a modified 5'-terminal end. In certain such embodiments, the 5'-terminal end comprises a modified phosphate moiety. In certain embodiments, such modified phosphate is stabilized (e.g., resistant to degradation/cleavage compared to unmodified 5'-phosphate). In certain embodiments, such 5'-terminal nucleosides stabilize the 5'-phosphorous moiety. Certain modified 5'-terminal nucleosides may be found in the art, for example in WO/2011/139702.

In certain embodiments, the 5'-nucleoside of an ssRNA compound has Formula IIc:

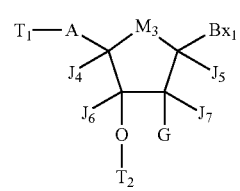

wherein:
T$_1$ is an optionally protected phosphorus moiety;
T$_2$ is an internucleoside linking group linking the compound of Formula IIc to the oligomeric compound;
A has one of the formulas:

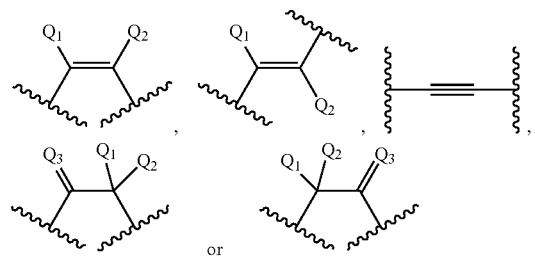

Q$_1$ and Q$_2$ are each, independently, H, halogen, C$_1$-C$_6$ alkyl, substituted C$_1$-C$_6$ alkyl, C$_1$-C$_6$ alkoxy, substituted $C_1$-$C_6$ alkoxy, $C_2$-$C_6$ alkenyl, substituted $C_2$-$C_6$ alkenyl, $C_2$-$C_6$ alkynyl, substituted $C_2$-$C_6$ alkynyl or $N(R_3)(R_4)$;

$Q_3$ is O, S, $N(R_5)$ or $C(R_6)(R_7)$;

each $R_3$, $R_4$ $R_5$, $R_6$ and $R_7$ is, independently, H, $C_1$-$C_6$ alkyl, substituted $C_1$-$C_6$ alkyl or $C_1$-$C_6$ alkoxy;

$M_3$ is O, S, $NR_{14}$, $C(R_{15})(R_{16})$, $C(R_{15})(R_{16})C(R_{17})(R_{18})$, $C(R_{15})=C(R_{17})$, $OC(R_{15})(R_{16})$ or $OC(R_{15})(Bx_2)$;

$R_{14}$ is H, $C_1$-$C_6$ alkyl, substituted $C_1$-$C_6$ alkyl, $C_1$-$C_6$ alkoxy, substituted $C_1$-$C_6$ alkoxy, $C_2$-$C_6$ alkenyl, substituted $C_2$-$C_6$ alkenyl, $C_2$-$C_6$ alkynyl or substituted $C_2$-$C_6$ alkynyl;

$R_{15}$, $R_{16}$, $R_{17}$ and $R_{18}$ are each, independently, H, halogen, $C_1$-$C_6$ alkyl, substituted $C_1$-$C_6$ alkyl, $C_1$-$C_6$ alkoxy, substituted $C_1$-$C_6$ alkoxy, $C_2$-$C_6$ alkenyl, substituted $C_2$-$C_6$ alkenyl, $C_2$-$C_6$ alkynyl or substituted $C_2$-$C_6$ alkynyl;

$Bx_1$ is a heterocyclic base moiety;

or if $Bx_2$ is present then $Bx_2$ is a heterocyclic base moiety and $Bx_1$ is H, halogen, $C_1$-$C_6$ alkyl, substituted $C_1$-$C_6$ alkyl, $C_1$-$C_6$ alkoxy, substituted $C_1$-$C_6$ alkoxy, $C_2$-$C_6$ alkenyl, substituted $C_2$-$C_6$ alkenyl, $C_2$-$C_6$ alkynyl or substituted $C_2$-$C_6$ alkynyl;

$J_4$, $J_5$, $J_6$ and $J_7$ are each, independently, H, halogen, $C_1$-$C_6$ alkyl, substituted $C_1$-$C_6$ alkyl, $C_1$-$C_6$ alkoxy, substituted $C_1$-$C_6$ alkoxy, $C_2$-$C_6$ alkenyl, substituted $C_2$-$C_6$ alkenyl, $C_2$-$C_6$ alkynyl or substituted $C_2$-$C_6$ alkynyl;

or $J_4$ forms a bridge with one of $J_5$ or $J_7$ wherein said bridge comprises from 1 to 3 linked biradical groups selected from O, S, $NR_{19}$, $C(R_{20})(R_{21})$, $C(R_{20})=C(R_{21})$, $C[=C(R_{20})(R_{21})]$ and $C(=O)$ and the other two of $J_5$, $J_6$ and $J_7$ are each, independently, H, halogen, $C_1$-$C_6$ alkyl, substituted $C_1$-$C_6$ alkyl, $C_1$-$C_6$ alkoxy, substituted $C_1$-$C_6$ alkoxy, $C_2$-$C_6$ alkenyl, substituted $C_2$-$C_6$ alkenyl, $C_2$-$C_6$ alkynyl or substituted $C_2$-$C_6$ alkynyl;

each $R_{19}$, $R_{20}$ and $R_{21}$ is, independently, H, $C_1$-$C_6$ alkyl, substituted $C_1$-$C_6$ alkyl, $C_1$-$C_6$ alkoxy, substituted $C_1$-$C_6$ alkoxy, $C_2$-$C_6$ alkenyl, substituted $C_2$-$C_6$ alkenyl, $C_2$-$C_6$ alkynyl or substituted $C_2$-$C_6$ alkynyl;

G is H, OH, halogen or O—$[C(R_8)(R_9)]_n$—$[(C=O)_m$—$X_1]_j$—Z;

each $R_8$ and $R_9$ is, independently, H, halogen, $C_1$-$C_6$ alkyl or substituted $C_1$-$C_6$ alkyl;

$X_1$ is O, S or $N(E_1)$;

Z is H, halogen, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl, substituted $C_2$-$C_6$ alkynyl or $N(E_2)(E_3)$;

$E_1$, $E_2$ and $E_3$ are each, independently, H, $C_1$-$C_6$ alkyl or substituted $C_1$-$C_6$ alkyl;

n is from 1 to about 6;

m is 0 or 1;

j is 0 or 1;

each substituted group comprises one or more optionally protected substituent groups independently selected from halogen, $OJ_1$, $N(J_1)(J_2)$, $=NJ_1$, $SJ_1$, $N_3$, CN, $OC(=X_2)J_1$, $OC(=X_2)N(J_1)(J_2)$ and $C(=X_2)N(J_1)(J_2)$;

$X_2$ is O, S or $NJ_3$;

each $J_1$, $J_2$ and $J_3$ is, independently, H or $C_1$-$C_6$ alkyl;

when j is 1 then Z is other than halogen or $N(E_2)(E_3)$; and wherein said oligomeric compound comprises from 8 to 40 monomeric subunits and is hybridizable to at least a portion of a target nucleic acid.

In certain embodiments, $M_3$ is O, CH=CH, $OCH_2$ or $OC(H)(Bx_2)$. In certain embodiments, $M_3$ is O.

In certain embodiments, $J_4$, $J_5$, $J_6$ and $J_7$ are each H. In certain embodiments, $J_4$ forms a bridge with one of $J_5$ or $J_7$.

In certain embodiments, A has one of the formulas:

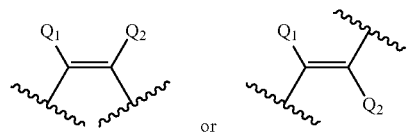

wherein:

$Q_1$ and $Q_2$ are each, independently, H, halogen, $C_1$-$C_6$ alkyl, substituted $C_1$-$C_6$ alkyl, $C_1$-$C_6$ alkoxy or substituted $C_1$-$C_6$ alkoxy. In certain embodiments, $Q_1$ and $Q_2$ are each H. In certain embodiments, $Q_1$ and $Q_2$ are each, independently, H or halogen. In certain embodiments, $Q_1$ and $Q_2$ is H and the other of $Q_1$ and $Q_2$ is F, $CH_3$ or $OCH_3$.

In certain embodiments, $T_1$ has the formula:

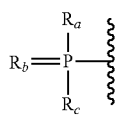

wherein:

$R_a$ and $R_c$ are each, independently, protected hydroxyl, protected thiol, $C_1$-$C_6$ alkyl, substituted $C_1$-$C_6$ alkyl, $C_1$-$C_6$ alkoxy, substituted $C_1$-$C_6$ alkoxy, protected amino or substituted amino; and $R_b$ is O or S. In certain embodiments, $R_b$ is O and $R_a$ and $R_c$ are each, independently, $OCH_3$, $OCH_2CH_3$ or $CH(CH_3)_2$.

In certain embodiments, G is halogen, $OCH_3$, $OCH_2F$, $OCHF_2$, $OCF_3$, $OCH_2CH_3$, $O(CH_2)_2F$, $OCH_2CHF_2$, $OCH_2CF_3$, $OCH_2$—CH=$CH_2$, $O(CH_2)_2$—$OCH_3$, $O(CH_2)_2$—$SCH_3$, $O(CH_2)_2$—$OCF_3$, $O(CH_2)_3$—$N(R_{10})(R_{11})$, $O(CH_2)_2$—$ON(R_{10})(R_{11})$, $O(CH_2)_2$—$O(CH_2)_2$—$N(R_{10})(R_{11})$, $OCH_2C(=O)$—$N(R_{10})(R_{11})$, $OCH_2C(=O)$—$N(R_{12})$—$(CH_2)_2$—$N(R_{10})(R_{11})$ or $O(CH_2)_2$—$N(R_{12})$—C$(=NR_{13})[N(R_{10})(R_{11})]$ wherein $R_{10}$, $R_{11}$, $R_{12}$ and $R_{13}$ are each, independently, H or $C_1$-$C_6$ alkyl. In certain embodiments, G is halogen, $OCH_3$, $OCF_3$, $OCH_2CH_3$, $OCH_2CF_3$, $OCH_2$—CH=$CH_2$, $O(CH_2)_2$—$OCH_3$, $O(CH_2)_2$—$O(CH_2)_2$—$N(CH_3)_2$, $OCH_2C(=O)$—$N(H)CH_3$, $OCH_2C(=O)$—$N(H)$—$(CH_2)_2$—$N(CH_3)_2$ or $OCH_2$—$N(H)$—C$(=NH)NH_2$. In certain embodiments, G is F, $OCH_3$ or $O(CH_2)_2$—$OCH_3$. In certain embodiments, G is $O(CH_2)_2$—$OCH_3$.

In certain embodiments, the 5'-terminal nucleoside has Formula IIe:

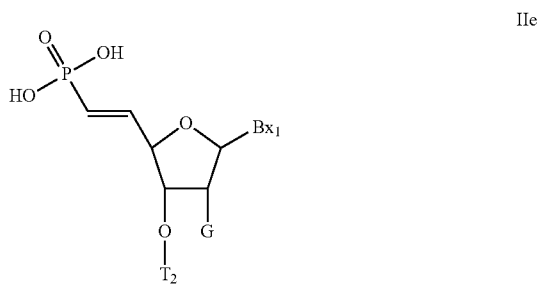

In certain embodiments, antisense compounds, including those particularly suitable for ssRNA comprise one or more type of modified sugar moieties and/or naturally occurring sugar moieties arranged along an oligonucleotide or region thereof in a defined pattern or sugar modification motif.

Such motifs may include any of the sugar modifications discussed herein and/or other known sugar modifications.

In certain embodiments, the oligonucleotides comprise or consist of a region having uniform sugar modifications. In certain such embodiments, each nucleoside of the region comprises the same RNA-like sugar modification. In certain embodiments, each nucleoside of the region is a 2'-F nucleoside. In certain embodiments, each nucleoside of the region is a 2'-OMe nucleoside. In certain embodiments, each nucleoside of the region is a 2'-MOE nucleoside. In certain embodiments, each nucleoside of the region is a cEt nucleoside. In certain embodiments, each nucleoside of the region is an LNA nucleoside. In certain embodiments, the uniform region constitutes all or essentially all of the oligonucleotide. In certain embodiments, the region constitutes the entire oligonucleotide except for 1-4 terminal nucleosides.

In certain embodiments, oligonucleotides comprise one or more regions of alternating sugar modifications, wherein the nucleosides alternate between nucleotides having a sugar modification of a first type and nucleotides having a sugar modification of a second type. In certain embodiments, nucleosides of both types are RNA-like nucleosides. In certain embodiments the alternating nucleosides are selected from: 2'-OMe, 2'-F, 2'-MOE, LNA, and cEt. In certain embodiments, the alternating modifications are 2'-F and 2'-OMe. Such regions may be contiguous or may be interrupted by differently modified nucleosides or conjugated nucleosides.

In certain embodiments, the alternating region of alternating modifications each consist of a single nucleoside (i.e., the pattern is $(AB)_xA_y$ wherein A is a nucleoside having a sugar modification of a first type and B is a nucleoside having a sugar modification of a second type; x is 1-20 and y is 0 or 1). In certain embodiments, one or more alternating regions in an alternating motif includes more than a single nucleoside of a type. For example, oligonucleotides may include one or more regions of any of the following nucleoside motifs:

AABBAA;
ABBABB;
AABAAB;
ABBABAABB;
ABABAA;
AABABAB;
ABABAA;
ABBAABBABABAA;
BABBAABBABABAA; or
ABABBAABBABABAA;

wherein A is a nucleoside of a first type and B is a nucleoside of a second type. In certain embodiments, A and B are each selected from 2'-F, 2'-OMe, BNA, and MOE.

In certain embodiments, oligonucleotides having such an alternating motif also comprise a modified 5' terminal nucleoside, such as those of formula IIc or IIe.

In certain embodiments, oligonucleotides comprise a region having a 2-2-3 motif. Such regions comprises the following motif:

$-(A)_2-(B)_x-(A)_2-(C)_y-(A)_3-$ wherein: A is a first type of modified nucleoside;
B and C, are nucleosides that are differently modified than A, however, B and C may have the same or different modifications as one another;
x and y are from 1 to 15.

In certain embodiments, A is a 2'-OMe modified nucleoside. In certain embodiments, B and C are both 2'-F modified nucleosides. In certain embodiments, A is a 2'-OMe modified nucleoside and B and C are both 2'-F modified nucleosides.

In certain embodiments, oligonucleosides have the following sugar motif:

$5'-(Q)-(AB)_xA_y-(D)_z$ wherein:
Q is a nucleoside comprising a stabilized phosphate moiety. In certain embodiments, Q is a nucleoside having Formula IIc or IIe;
A is a first type of modified nucleoside;
B is a second type of modified nucleoside;
D is a modified nucleoside comprising a modification different from the nucleoside adjacent to it. Thus, if y is 0, then D must be differently modified than B and if y is 1, then D must be differently modified than A. In certain embodiments, D differs from both A and B.
X is 5-15;
Y is 0 or 1;
Z is 0-4.

In certain embodiments, oligonucleosides have the following sugar motif:

$5'-(Q)-(A)_x-(D)_z$ wherein:
Q is a nucleoside comprising a stabilized phosphate moiety. In certain embodiments, Q is a nucleoside having Formula IIc or IIe;
A is a first type of modified nucleoside;
D is a modified nucleoside comprising a modification different from A.
X is 11-30;
Z is 0-4.

In certain embodiments A, B, C, and D in the above motifs are selected from: 2'-OMe, 2'-F, 2'-MOE, LNA, and cEt. In certain embodiments, D represents terminal nucleosides. In certain embodiments, such terminal nucleosides are not designed to hybridize to the target nucleic acid (though one or more might hybridize by chance). In certain embodiments, the nucleobase of each D nucleoside is adenine, regardless of the identity of the nucleobase at the corresponding position of the target nucleic acid. In certain embodiments the nucleobase of each D nucleoside is thymine.

In certain embodiments, antisense compounds, including those particularly suited for use as ssRNA comprise modified internucleoside linkages arranged along the oligonucleotide or region thereof in a defined pattern or modified internucleoside linkage motif. In certain embodiments, oligonucleotides comprise a region having an alternating internucleoside linkage motif. In certain embodiments, oligonucleotides comprise a region of uniformly modified internucleoside linkages. In certain such embodiments, the oligonucleotide comprises a region that is uniformly linked by phosphorothioate internucleoside linkages. In certain embodiments, the oligonucleotide is uniformly linked by phosphorothioate internucleoside linkages. In certain embodiments, each internucleoside linkage of the oligonucleotide is selected from phosphodiester and phosphorothioate. In certain embodiments, each internucleoside linkage of the oligonucleotide is selected from phosphodiester and phosphorothioate and at least one internucleoside linkage is phosphorothioate.

In certain embodiments, the oligonucleotide comprises at least 6 phosphorothioate internucleoside linkages. In certain embodiments, the oligonucleotide comprises at least 8 phosphorothioate internucleoside linkages. In certain embodiments, the oligonucleotide comprises at least 10 phosphorothioate internucleoside linkages. In certain embodiments, the oligonucleotide comprises at least one block of at least 6 consecutive phosphorothioate internucleoside linkages. In certain embodiments, the oligonucleotide comprises at least one block of at least 8 consecutive phosphorothioate internucleoside linkages. In certain embodiments, the oligonucleotide comprises at least one block of at least 10 consecutive phosphorothioate internucleoside linkages. In certain embodiments, the oligonucleotide comprises at least one block of at least one 12 consecutive phosphorothioate internucleoside linkages. In certain such embodiments, at least one such block is located at the 3' end of the oligonucleotide. In certain such embodiments, at least one such block is located within 3 nucleosides of the 3' end of the oligonucleotide.

Oligonucleotides having any of the various sugar motifs described herein, may have any linkage motif. For example, the oligonucleotides, including but not limited to those described above, may have a linkage motif selected from non-limiting the table below:

| 5' most linkage | Central region | 3'-region |
|---|---|---|
| PS | Alternating PO/PS | 6 PS |
| PS | Alternating PO/PS | 7 PS |
| PS | Alternating PO/PS | 8 PS | ii. siRNA Compounds

In certain embodiments, antisense compounds are double-stranded RNAi compounds (siRNA). In such embodiments, one or both strands may comprise any modification motif described above for ssRNA. In certain embodiments, ssRNA compounds may be unmodified RNA. In certain embodiments, siRNA compounds may comprise unmodified RNA nucleosides, but modified internucleoside linkages.

Several embodiments relate to double-stranded compositions wherein each strand comprises a motif defined by the location of one or more modified or unmodified nucleosides. In certain embodiments, compositions are provided comprising a first and a second oligomeric compound that are fully or at least partially hybridized to form a duplex region and further comprising a region that is complementary to and hybridizes to a nucleic acid target. It is suitable that such a composition comprise a first oligomeric compound that is an antisense strand having full or partial complementarity to a nucleic acid target and a second oligomeric compound that is a sense strand having one or more regions of complementarity to and forming at least one duplex region with the first oligomeric compound.

The compositions of several embodiments modulate gene expression by hybridizing to a nucleic acid target resulting in loss of its normal function. In some embodiments, the target nucleic acid is UBE3A-ATS. In certain embodiment, the degradation of the targeted UBE3A-ATS is facilitated by an activated RISC complex that is formed with compositions of the invention.

Several embodiments are directed to double-stranded compositions wherein one of the strands is useful in, for example, influencing the preferential loading of the opposite strand into the RISC (or cleavage) complex. The compositions are useful for targeting selected nucleic acid molecules and modulating the expression of one or more genes. In some embodiments, the compositions of the present invention hybridize to a portion of a target RNA resulting in loss of normal function of the target RNA.

Certain embodiments are drawn to double-stranded compositions wherein both the strands comprises a hemimer motif, a fully modified motif, a positionally modified motif or an alternating motif. Each strand of the compositions of the present invention can be modified to fulfil a particular role in for example the siRNA pathway. Using a different motif in each strand or the same motif with different chemical modifications in each strand permits targeting the antisense strand for the RISC complex while inhibiting the incorporation of the sense strand. Within this model, each strand can be independently modified such that it is enhanced for its particular role. The antisense strand can be modified at the 5'-end to enhance its role in one region of the RISC while the 3'-end can be modified differentially to enhance its role in a different region of the RISC.

The double-stranded oligonucleotide molecules can be a double-stranded polynucleotide molecule comprising self-complementary sense and antisense regions, wherein the antisense region comprises nucleotide sequence that is complementary to nucleotide sequence in a target nucleic acid molecule or a portion thereof and the sense region having nucleotide sequence corresponding to the target nucleic acid sequence or a portion thereof. The double-stranded oligonucleotide molecules can be assembled from two separate oligonucleotides, where one strand is the sense strand and the other is the antisense strand, wherein the antisense and sense strands are self-complementary (i.e. each strand comprises nucleotide sequence that is complementary to nucleotide sequence in the other strand; such as where the antisense strand and sense strand form a duplex or double-stranded structure, for example wherein the double-stranded region is about 15 to about 30, e.g., about 15, 16, 17, 18, 19, 20, 21, 22, 23, 24, 25, 26, 27, 28, 29 or 30 base pairs; the antisense strand comprises nucleotide sequence that is complementary to nucleotide sequence in a target nucleic acid molecule or a portion thereof and the sense strand comprises nucleotide sequence corresponding to the target nucleic acid sequence or a portion thereof (e.g., about 15 to about 25 or more nucleotides of the double-stranded oligonucleotide molecule are complementary to the target nucleic acid or a portion thereof). Alternatively, the double-stranded oligonucleotide is assembled from a single oligonucleotide, where the self-complementary sense and antisense regions of the siRNA are linked by means of a nucleic acid based or non-nucleic acid-based linker(s).

The double-stranded oligonucleotide can be a polynucleotide with a duplex, asymmetric duplex, hairpin or asymmetric hairpin secondary structure, having self-complementary sense and antisense regions, wherein the antisense region comprises nucleotide sequence that is complementary to nucleotide sequence in a separate target nucleic acid molecule or a portion thereof and the sense region having nucleotide sequence corresponding to the target nucleic acid sequence or a portion thereof. The double-stranded oligonucleotide can be a circular single-stranded polynucleotide having two or more loop structures and a stem comprising self-complementary sense and antisense regions, wherein the antisense region comprises nucleotide sequence that is complementary to nucleotide sequence in a target nucleic acid molecule or a portion thereof and the sense region having nucleotide sequence corresponding to the target nucleic acid sequence or a portion thereof, and wherein the circular polynucleotide can be processed either in vivo or in vitro to generate an active siRNA molecule capable of mediating RNAi.

In certain embodiments, the double-stranded oligonucleotide comprises separate sense and antisense sequences or regions, wherein the sense and antisense regions are covalently linked by nucleotide or non-nucleotide linkers molecules as is known in the art, or are alternately non-covalently linked by ionic interactions, hydrogen bonding, van der waals interactions, hydrophobic interactions, and/or stacking interactions. In certain embodiments, the double-stranded oligonucleotide comprises nucleotide sequence that is complementary to nucleotide sequence of a target gene. In another embodiment, the double-stranded oligonucleotide interacts with nucleotide sequence of a target gene in a manner that causes inhibition of expression of the target gene.

As used herein, double-stranded oligonucleotides need not be limited to those molecules containing only RNA, but further encompasses chemically modified nucleotides and non-nucleotides. In certain embodiments, the short interfering nucleic acid molecules lack 2'-hydroxy (2'-OH) containing nucleotides. In certain embodiments short interfering nucleic acids optionally do not include any ribonucleotides (e.g., nucleotides having a 2'-OH group). Such double-stranded oligonucleotides that do not require the presence of ribonucleotides within the molecule to support RNAi can however have an attached linker or linkers or other attached or associated groups, moieties, or chains containing one or more nucleotides with 2'-OH groups. Optionally, double-stranded oligonucleotides can comprise ribonucleotides at about 5, 10, 20, 30, 40, or 50% of the nucleotide positions. As used herein, the term siRNA is meant to be equivalent to other terms used to describe nucleic acid molecules that are capable of mediating sequence specific RNAi, for example short interfering RNA (siRNA), double-stranded RNA (dsRNA), micro-RNA (miRNA), short hairpin RNA (shRNA), short interfering oligonucleotide, short interfering nucleic acid, short interfering modified oligonucleotide, chemically modified siRNA, post-transcriptional gene silencing RNA (ptgsRNA), and others. In addition, as used herein, the term RNAi is meant to be equivalent to other terms used to describe sequence specific RNA interference, such as post transcriptional gene silencing, translational inhibition, or epigenetics. For example, double-stranded oligonucleotides can be used to epigenetically silence genes at both the post-transcriptional level and the pre-transcriptional level. In a non-limiting example, epigenetic regulation of gene expression by siRNA molecules of the invention can result from siRNA mediated modification of chromatin structure or methylation pattern to alter gene expression (see, for example, Verdel et al., 2004, Science, 303, 672-676; Pal-Bhadra et al., 2004, Science, 303, 669-672; Allshire, 2002, Science, 297, 1818-1819; Volpe et al., 2002, Science, 297, 1833-1837; Jenuwein, 2002, Science, 297, 2215-2218; and Hall et al., 2002, Science, 297, 2232-2237).

It is contemplated that compounds and compositions of several embodiments provided herein can target UBE3A-ATS by a dsRNA-mediated gene silencing or RNAi mechanism, including, e.g., "hairpin" or stem-loop double-stranded RNA effector molecules in which a single RNA strand with self-complementary sequences is capable of assuming a double-stranded conformation, or duplex dsRNA effector molecules comprising two separate strands of RNA. In various embodiments, the dsRNA consists entirely of ribonucleotides or consists of a mixture of ribonucleotides and deoxyribonucleotides, such as the RNA/DNA hybrids disclosed, for example, by WO 00/63364, filed Apr. 19, 2000, or U.S. Ser. No. 60/130,377, filed Apr. 21, 1999. The dsRNA or dsRNA effector molecule may be a single molecule with a region of self-complementarity such that nucleotides in one segment of the molecule base pair with nucleotides in another segment of the molecule. In various embodiments, a dsRNA that consists of a single molecule consists entirely of ribonucleotides or includes a region of ribonucleotides that is complementary to a region of deoxyribonucleotides. Alternatively, the dsRNA may include two different strands that have a region of complementarity to each other.

In various embodiments, both strands consist entirely of ribonucleotides, one strand consists entirely of ribonucleotides and one strand consists entirely of deoxyribonucleotides, or one or both strands contain a mixture of ribonucleotides and deoxyribonucleotides. In certain embodiments, the regions of complementarity are at least 70, 80, 90, 95, 98, or 100% complementary to each other and to a target nucleic acid sequence. In certain embodiments, the region of the dsRNA that is present in a double-stranded conformation includes at least 19, 20, 21, 22, 23, 24, 25, 26, 27, 28, 29, 30, 50, 75, 100, 200, 500, 1000, 2000 or 5000 nucleotides or includes all of the nucleotides in a cDNA or other target nucleic acid sequence being represented in the dsRNA. In some embodiments, the dsRNA does not contain any single stranded regions, such as single stranded ends, or the dsRNA is a hairpin. In other embodiments, the dsRNA has one or more single stranded regions or overhangs. In certain embodiments, RNA/DNA hybrids include a DNA strand or region that is an antisense strand or region (e.g, has at least 70, 80, 90, 95, 98, or 100% complementarity to a target nucleic acid) and an RNA strand or region that is a sense strand or region (e.g, has at least 70, 80, 90, 95, 98, or 100% identity to a target nucleic acid), and vice versa.

In various embodiments, the RNA/DNA hybrid is made in vitro using enzymatic or chemical synthetic methods such as those described herein or those described in WO 00/63364, filed Apr. 19, 2000, or U.S. Ser. No. 60/130,377, filed Apr. 21, 1999. In other embodiments, a DNA strand synthesized in vitro is complexed with an RNA strand made in vivo or in vitro before, after, or concurrent with the transformation of the DNA strand into the cell. In yet other embodiments, the dsRNA is a single circular nucleic acid containing a sense and an antisense region, or the dsRNA includes a circular nucleic acid and either a second circular nucleic acid or a linear nucleic acid (see, for example, WO 00/63364, filed Apr. 19, 2000, or U.S. Ser. No. 60/130,377, filed Apr. 21, 1999.) Exemplary circular nucleic acids include lariat structures in which the free 5' phosphoryl group of a nucleotide becomes linked to the 2' hydroxyl group of another nucleotide in a loop back fashion.

In other embodiments, the dsRNA includes one or more modified nucleotides in which the 2' position in the sugar contains a halogen (such as fluorine group) or contains an alkoxy group (such as a methoxy group) which increases the half-life of the dsRNA in vitro or in vivo compared to the corresponding dsRNA in which the corresponding 2' position contains a hydrogen or an hydroxyl group. In yet other embodiments, the dsRNA includes one or more linkages between adjacent nucleotides other than a naturally-occurring phosphodiester linkage. Examples of such linkages include phosphoramide, phosphorothioate, and phosphorodithioate linkages. The dsRNAs may also be chemically modified nucleic acid molecules as taught in U.S. Pat. No. 6,673,661. In other embodiments, the dsRNA contains one or two capped strands, as disclosed, for example, by WO 00/63364, filed Apr. 19, 2000, or U.S. Ser. No. 60/130,377, filed Apr. 21, 1999.

In other embodiments, the dsRNA can be any of the at least partially dsRNA molecules disclosed in WO 00/63364, as well as any of the dsRNA molecules described in U.S. Provisional Application 60/399,998; and U.S. Provisional Application 60/419,532, and PCT/US2003/033466, the teaching of which is hereby incorporated by reference. Any of the dsRNAs may be expressed in vitro or in vivo using the methods described herein or standard methods, such as those described in WO 00/63364.

Occupancy

In certain embodiments, antisense compounds are not expected to result in cleavage or the target nucleic acid via RNase H or to result in cleavage or sequestration through the RISC pathway. In certain such embodiments, antisense activity may result from occupancy, wherein the presence of the hybridized antisense compound disrupts the activity of the target nucleic acid. In certain such embodiments, the antisense compound may be uniformly modified or may comprise a mix of modifications and/or modified and unmodified nucleosides.

Target Nucleic Acids, Target Regions and Nucleotide Sequences

In certain embodiments, the UBE3A-ATS nucleic acid comprises the sequence set forth in the complement of GENBANK Accession No. NT_187035.1 truncated from nucleotides 66484120 to 67595063 (incorporated herein as SEQ ID NO: 1) or the sequence set forth in GENBANK Accession No. NT_026446.14 truncated from nucleotides 25068794 to 25684175 (incorporated herein as SEQ ID NO: 2). SEQ ID NO: 1 provides sequence from chromosome 7 of the mouse genome and SEQ ID NO: 2 provides sequence from chromosome 15 of the human genome. The mouse and human genomic loci corresponding to these SEQ ID NOs share a highly conserved genomic organization that includes a Snrpn gene, snoRNAs, and UBE3A-ATS in the same structural arrangement along their syntenic chromosomes. In addition to the highly conserved genomic map of the mouse and human syntenic loci, the genomic imprinting mechanism is also conserved at this loci; in mice and humans, most neurons express Ube3a only from the maternally-inherited allele. (Huang, H. S. et al., Nature, 481: 185-189, 2012)

In certain embodiments, UBE3A-ATS comprises a nucleic acid sequence at least 85%, at least 90%, at least 95%, or 100% identical to the complement of GENBANK Accession No. NT_187035.1 truncated from nucleotides 66484120 to 67595063 (incorporated herein as SEQ ID NO: 1) or GENBANK Accession No. NT_026446.14 truncated from nucleotides 25068794 to 25684175 (incorporated herein as SEQ ID NO: 2). In certain embodiments, UBE3A comprises a nucleic acid sequence at least 85%, at least 90%, at least 95%, or 100% identical to the reverse complement of nucleotides 1032967 to 1110944 of SEQ ID NO: 1 (incorporated herein as SEQ ID NO: 5) or the reverse complement of nucleotides 513603 to 615382 of SEQ ID NO: 2 (incorporated herein as SEQ ID NO: 6).

Targeting includes determination of at least one target segment to which an antisense compound hybridizes, such that a desired effect occurs. In certain embodiments, the desired effect is a reduction in UBE3A-ATS nucleic acid levels. In certain embodiments, the desired effect is induced expression of paternal UBE3A.

In certain embodiments, antisense compounds are targeted to UBE3A-ATS, which comprises a nucleic acid sequence at least 85%, at least 90%, at least 95%, or 100% identical to the complement of GENBANK Accession No. NT_187035.1 truncated from nucleotides 66484120 to 67595063 (incorporated herein as SEQ ID NO: 1) or GENBANK Accession No. NT_026446.14 truncated from nucleotides 25068794 to 25684175 (incorporated herein as SEQ ID NO: 2). In certain aspects, antisense compounds are targeted to a region of UBE3A-ATS upstream from the region of UBE3A-ATS complementary to at least the 3' end of a UBE3A pre-mRNA. Stated differently, in certain aspects antisense compounds are targeted to a region of UBE3A-ATS that is upstream from the region of UBE3A-ATS overlapping or antisense to UBE3A. For example, the region of UBE3A-ATS complementary to at least the 3' end of the UBE3A pre-mRNA can start at nucleobase 1032967 of SEQ ID NO: 1 or nucleobase 513603 of SEQ ID NO: 2. In certain aspects, the region of UBE3A-ATS complementary to at least the 3' end of the UBE3A pre-mRNA can consist of nucleobases 1032967 to 1110944 of SEQ ID NO: 1 or nucleobases 513603 to 615382 of SEQ ID NO: 2.

In certain embodiments, antisense compounds are targeted to a first region of UBE3A-ATS that is flanked by (a) an upstream region and (b) a downstream region complementary to at least the 3' end of a UBE3A pre-mRNA. Stated differently, in certain embodiments, antisense compounds are targeted to a first region of UBE3A-ATS that is flanked by (a) an upstream region and (b) a downstream region that overlaps or is antisense to UBE3A. In certain embodiments, the first region can consist of a nucleotide sequence at least 85%, at least 90%, at least 95%, or 100% identical to nucleobases 997469 to 1032966 of SEQ ID NO: 1 (the complement of GENBANK Accession No. NT_187035.1 truncated from nucleotides 66484120 to 67595063). In certain embodiments, the first region can consist of a nucleotide sequence at least 85%, at least 90%, at least 95, or 100% identical to nucleobases 446213 to 513602 of SEQ ID NO: 2 (GENBANK Accession No. NT_026446.14 truncated from nucleotides 25068794 to 25684175). In certain aspects, the downstream region complementary to at least the 3' end of the UBE3A pre-mRNA can consist of nucleobases 1032967 to 1110944 of SEQ ID NO: 1 or nucleobases 513603 to 615382 of SEQ ID NO: 2.

In certain embodiments, antisense compounds are targeted to UBE3A-ATS within 35498 nucleobases upstream from the start of a region complementary to at least the 3' end of the UBE3A pre-mRNA, wherein UBE3A-ATS comprises a nucleic acid sequence at least 85%, at least 90%, at least 95%, or 100% identical to the complement of GENBANK Accession No. NT_187035.1 truncated from nucleotides 66484120 to 67595063 (incorporated herein as SEQ ID NO: 1). In certain aspects, the region complementary to at least the 3' end the UBE3A pre-mRNA consists of nucleobases 1032967 to 1110944 of SEQ ID NO: 1. In certain embodiments antisense compounds are targeted to UBE3A-ATS within 35498 nucleobases upstream from the region of UBE3A-ATS (SEQ ID NO:1) overlapping or antisense to UBE3A.

In certain embodiments, antisense compounds are targeted to UBE3A-ATS within 67390 nucleobases upstream from the start of a region complementary to the UBE3A pre-mRNA, wherein UBE3A-ATS comprises a nucleic acid sequence at least 85%, at least 90%, at least 95%, or 100% identical to GENBANK Accession No. NT_026446.14 truncated from nucleotides 25068794 to 25684175. In certain aspects, the region complementary to the UBE3A pre-mRNA consists of nucleobases 513603 through 615382 of SEQ ID NO: 2. In certain embodiments, antisense compounds are targeted to UBE3A-ATS within 67390 nucleobases upstream from the region of UBE3A-ATS (SEQ ID NO: 2) overlapping or antisense to UBE3A.

In certain embodiments, antisense compounds target UBE3A-ATS immediately downstream of HBII-52 or MBII-52 snoRNA to the region overlapping or antisense to UBE3A. In several aspects, such antisense compounds target UBE3A-ATS between nucleobases 1 to 35499 of SEQ ID NO: 3. In several aspects, such antisense compounds target UBE3A-ATS between nucleobases 1 to 67391 of SEQ ID NO: 4.

There may be variation in activity (e.g., as defined by percent reduction of UBE3A-ATS nucleic acid levels or percent induction of paternal UBE3A expression) of the antisense compounds within an active target region. In certain embodiments, an induction of paternal UBE3A expression is indicative of inhibition of UBE3A-ATS expression.

Hybridization

In some embodiments, hybridization occurs between an antisense compound disclosed herein and an UBE3A-ATS. The most common mechanism of hybridization involves hydrogen bonding (e.g., Watson-Crick, Hoogsteen or reversed Hoogsteen hydrogen bonding) between complementary nucleobases of the nucleic acid molecules.

Hybridization can occur under varying conditions. Stringent conditions are sequence-dependent and are determined by the nature and composition of the nucleic acid molecules to be hybridized.

Methods of determining whether a sequence is specifically hybridizable to a target nucleic acid are well known in the art. In certain embodiments, the antisense compounds provided herein are specifically hybridizable with UBE3A-ATS.

Complementarity

An antisense compound and a target nucleic acid are complementary to each other when a sufficient number of nucleobases of the antisense compound can hydrogen bond with the corresponding nucleobases of the target nucleic acid, such that a desired effect will occur (e.g., antisense inhibition of a target nucleic acid, such as a UBE3A-ATS nucleic acid).

Non-complementary nucleobases between an antisense compound and a UBE3A-ATS nucleic acid may be tolerated provided that the antisense compound remains able to specifically hybridize to a target nucleic acid. Moreover, an antisense compound may hybridize over one or more segments of a UBE3A-ATS nucleic acid such that intervening or adjacent segments are not involved in the hybridization event (e.g., a loop structure, mismatch or hairpin structure).

In certain embodiments, the antisense compounds provided herein, or a specified portion thereof, are, or are at least, 70%, 80%, 85%, 86%, 87%, 88%, 89%, 90%, 91%, 92%, 93%, 94%, 95%, 96%, 97%, 98%, 99%, or 100% complementary to a UBE3A-ATS nucleic acid, a target region, target segment, or specified portion thereof. Percent complementarity of an antisense compound with a target nucleic acid can be determined using routine methods.

For example, an antisense compound in which 18 of 20 nucleobases of the antisense compound are complementary to a target region, and would therefore specifically hybridize, would represent 90 percent complementarity. In this example, the remaining noncomplementary nucleobases may be clustered or interspersed with complementary nucleobases and need not be contiguous to each other or to complementary nucleobases. As such, an antisense compound which is 18 nucleobases in length having four non-complementary nucleobases which are flanked by two regions of complete complementarity with the target nucleic acid would have 77.8% overall complementarity with the target nucleic acid and would thus fall within the scope of the present invention. Percent complementarity of an antisense compound with a region of a target nucleic acid can be determined routinely using BLAST programs (basic local alignment search tools) and PowerBLAST programs known in the art (Altschul et al., *J. Mol. Biol.*, 1990, 215, 403 410; Zhang and Madden, Genome Res., 1997, 7, 649 656). Percent homology, sequence identity or complementarity, can be determined by, for example, the Gap program (Wisconsin Sequence Analysis Package, Version 8 for Unix, Genetics Computer Group, University Research Park, Madison Wis.), using default settings, which uses the algorithm of Smith and Waterman (Adv. Appl. Math., 1981, 2, 482 489).

In certain embodiments, the antisense compounds provided herein, or specified portions thereof, are fully complementary (i.e. 100% complementary) to a target nucleic acid, or specified portion thereof. For example, an antisense compound may be fully complementary to a UBE3A-ATS nucleic acid, or a target region, or a target segment or target sequence thereof. As used herein, "fully complementary" means each nucleobase of an antisense compound is capable of precise base pairing with the corresponding nucleobases of a target nucleic acid. For example, a 20 nucleobase antisense compound is fully complementary to a target sequence that is 400 nucleobases long, so long as there is a corresponding 20 nucleobase portion of the target nucleic acid that is fully complementary to the antisense compound. Fully complementary can also be used in reference to a specified portion of the first and/or the second nucleic acid. For example, a 20 nucleobase portion of a 30 nucleobase antisense compound can be "fully complementary" to a target sequence that is 400 nucleobases long. The 20 nucleobase portion of the 30 nucleobase oligonucleotide is fully complementary to the target sequence if the target sequence has a corresponding 20 nucleobase portion wherein each nucleobase is complementary to the 20 nucleobase portion of the antisense compound. At the same time, the entire 30 nucleobase antisense compound may or may not be fully complementary to the target sequence, depending on whether the remaining 10 nucleobases of the antisense compound are also complementary to the target sequence.

The location of a non-complementary nucleobase may be at the 5' end or 3' end of the antisense compound. Alternatively, the non-complementary nucleobase or nucleobases may be at an internal position of the antisense compound. When two or more non-complementary nucleobases are present, they may be contiguous (i.e. linked) or non-contiguous. In one embodiment, a non-complementary nucleobase is located in the wing segment of a gapmer antisense oligonucleotide.

In certain embodiments, antisense compounds that are, or are up to 11, 12, 13, 14, 15, 16, 17, 18, 19, or 20 nucleobases in length comprise no more than 4, no more than 3, no more than 2, or no more than 1 non-complementary nucleobase(s) relative to a target nucleic acid, such as a UBE3A-ATS nucleic acid, or specified portion thereof.

In certain embodiments, antisense compounds that are, or are up to 11, 12, 13, 14, 15, 16, 17, 18, 19, 20, 21, 22, 23, 24, 25, 26, 27, 28, 29, or 30 nucleobases in length comprise no more than 6, no more than 5, no more than 4, no more than 3, no more than 2, or no more than 1 non-complementary nucleobase(s) relative to a target nucleic acid, such as a UBE3A-ATS nucleic acid, or specified portion thereof.

The antisense compounds provided also include those which are complementary to a portion of a target nucleic acid. As used herein, "portion" refers to a defined number of contiguous (i.e. linked) nucleobases within a region or segment of a target nucleic acid. A "portion" can also refer to a defined number of contiguous nucleobases of an antisense compound. In certain embodiments, the antisense compounds, are complementary to at least an 8 nucleobase portion of a target segment. In certain embodiments, the antisense compounds are complementary to at least a 9 nucleobase portion of a target segment. In certain embodiments, the antisense compounds are complementary to at least a 10 nucleobase portion of a target segment. In certain embodiments, the antisense compounds are complementary to at least an 11 nucleobase portion of a target segment. In certain embodiments, the antisense compounds are complementary to at least a 12 nucleobase portion of a target segment. In certain embodiments, the antisense compounds are complementary to at least a 13 nucleobase portion of a target segment. In certain embodiments, the antisense compounds are complementary to at least a 14 nucleobase portion of a target segment. In certain embodiments, the antisense compounds are complementary to at least a 15 nucleobase portion of a target segment. Also contemplated are antisense compounds that are complementary to at least a 9, 10, 11, 12, 13, 14, 15, 16, 17, 18, 19, 20, or more nucleobase portion of a target segment, or a range defined by any two of these values.

Identity

The antisense compounds provided herein may also have a defined percent identity to a particular nucleotide sequence, SEQ ID NO, or compound represented by a specific Isis number, or portion thereof. As used herein, an antisense compound is identical to the sequence disclosed herein if it has the same nucleobase pairing ability. For example, a RNA which contains uracil in place of thymidine in a disclosed DNA sequence would be considered identical to the DNA sequence since both uracil and thymidine pair with adenine. Shortened and lengthened versions of the antisense compounds described herein as well as compounds having non-identical bases relative to the antisense compounds provided herein also are contemplated. The non-identical bases may be adjacent to each other or dispersed throughout the antisense compound. Percent identity of an antisense compound is calculated according to the number of bases that have identical base pairing relative to the sequence to which it is being compared.

In certain embodiments, the antisense compounds, or portions thereof, are at least 70%, 75%, 80%, 85%, 90%, 95%, 96%, 97%, 98%, 99% or 100% identical to one or more of the antisense compounds or SEQ ID NOs, or a portion thereof, disclosed herein.

In certain embodiments, a portion of the antisense compound is compared to an equal length portion of the target nucleic acid. In certain embodiments, an 8, 9, 10, 11, 12, 13, 14, 15, 16, 17, 18, 19, 20, 21, 22, 23, 24, or 25 nucleobase portion is compared to an equal length portion of the target nucleic acid.

In certain embodiments, a portion of the antisense oligonucleotide is compared to an equal length portion of the target nucleic acid. In certain embodiments, an 8, 9, 10, 11, 12, 13, 14, 15, 16, 17, 18, 19, 20, 21, 22, 23, 24, or 25 nucleobase portion is compared to an equal length portion of the target nucleic acid.

Modifications

A nucleoside is a base-sugar combination. The nucleobase (also known as base) portion of the nucleoside is normally a heterocyclic base moiety. Nucleotides are nucleosides that further include a phosphate group covalently linked to the sugar portion of the nucleoside. For those nucleosides that include a pentofuranosyl sugar, the phosphate group can be linked to the 2', 3' or 5' hydroxyl moiety of the sugar. Oligonucleotides are formed through the covalent linkage of adjacent nucleosides to one another, to form a linear polymeric oligonucleotide. Within the oligonucleotide structure, the phosphate groups are commonly referred to as forming the internucleoside linkages of the oligonucleotide.

Modifications to antisense compounds encompass substitutions or changes to internucleoside linkages, sugar moieties, or nucleobases. Modified antisense compounds are often preferred over native forms because of desirable properties such as, for example, enhanced cellular uptake, enhanced affinity for nucleic acid target, increased stability in the presence of nucleases, or increased inhibitory activity.

Chemically modified nucleosides may also be employed to increase the binding affinity of a shortened or truncated antisense oligonucleotide for its target nucleic acid. Consequently, comparable results can often be obtained with shorter antisense compounds that have such chemically modified nucleosides.

Modified Internucleoside Linkages

The naturally occurring internucleoside linkage of RNA and DNA is a 3' to 5' phosphodiester linkage. Antisense compounds having one or more modified, i.e. non-naturally occurring, internucleoside linkages are often selected over antisense compounds having naturally occurring internucleoside linkages because of desirable properties such as, for example, enhanced cellular uptake, enhanced affinity for target nucleic acids, and increased stability in the presence of nucleases.

Oligonucleotides having modified internucleoside linkages include internucleoside linkages that retain a phosphorus atom as well as internucleoside linkages that do not have a phosphorus atom. Representative phosphorus containing internucleoside linkages include, but are not limited to, phosphodiesters, phosphotriesters, methylphosphonates, phosphoramidate, and phosphorothioates. Methods of preparation of phosphorous-containing and non-phosphorous-containing linkages are well known.

In certain embodiments, antisense compounds targeted to a UBE3A-ATS nucleic acid comprise one or more modified internucleoside linkages. In certain embodiments, the modified internucleoside linkages are phosphorothioate linkages. In certain embodiments, each internucleoside linkage of an antisense compound is a phosphorothioate internucleoside linkage.

Modified Sugar Moieties

Antisense compounds can optionally contain one or more nucleosides wherein the sugar group has been modified. Such sugar modified nucleosides may impart enhanced nuclease stability, increased binding affinity, or some other beneficial biological property to the antisense compounds. In certain embodiments, nucleosides comprise chemically modified ribofuranose ring moieties. Examples of chemically modified ribofuranose rings include without limitation, addition of substitutent groups (including 5' and 2' substituent groups, bridging of non-geminal ring atoms to form bicyclic nucleic acids (BNA), replacement of the ribosyl ring oxygen atom with S, N(R), or C($R_1$)($R_2$) (R, $R_1$ and $R_2$ are each independently H, $C_1$-$C_{12}$ alkyl or a protecting group) and combinations thereof. Examples of chemically modified sugars include 2'-F-5'-methyl substituted nucleoside (see PCT International Application WO 2008/101157 Published on Aug. 21, 2008 for other disclosed 5',2'-bis substituted nucleosides) or replacement of the ribosyl ring oxygen atom with S with further substitution at the 2'-position (see published U.S. Patent Application US2005-0130923, published on Jun. 16, 2005) or alternatively 5'-substitution of a BNA (see PCT International Application WO 2007/134181 Published on Nov. 22, 2007 wherein LNA is substituted with for example a 5'-methyl or a 5'-vinyl group).

Examples of nucleosides having modified sugar moieties include without limitation nucleosides comprising 5'-vinyl, 5'-methyl (R or S), 4'-S, 2'-F, 2'-OCH$_3$, 2'-OCH$_2$CH$_3$, 2'-OCH$_2$CH$_2$F and 2'-O(CH$_2$)$_2$OCH$_3$ substituent groups. The substituent at the 2' position can also be selected from allyl, amino, azido, thio, O-allyl, O—C$_1$-C$_{10}$ alkyl, OCF$_3$, OCH$_2$F, O(CH$_2$)$_2$SCH$_3$, O(CH$_2$)$_2$—O—N(R$_m$)(R$_n$), O—CH$_2$—C(=O)—N(R$_m$)(R$_n$), and O—CH$_2$—C(=O)—N(R$_l$)—(CH$_2$)$_2$—N(R$_m$)(R$_n$), where each R$_l$, R$_m$ and R$_n$ is, independently, H or substituted or unsubstituted C$_1$-C$_{10}$ alkyl.

As used herein, "bicyclic nucleosides" refer to modified nucleosides comprising a bicyclic sugar moiety. Examples of bicyclic nucleosides include without limitation nucleosides comprising a bridge between the 4' and the 2' ribosyl ring atoms. In certain embodiments, antisense compounds provided herein include one or more bicyclic nucleosides comprising a 4' to 2' bridge. Examples of such 4' to 2' bridged bicyclic nucleosides, include but are not limited to one of the formulae: 4'-(CH$_2$)—O-2' (LNA); 4'-(CH$_2$)—S-2; 4'-(CH$_2$)$_2$—O-2' (ENA); 4'-CH(CH$_3$)—O-2' (also referred to as constrained ethyl or cEt) and 4'-CH(CH$_2$OCH$_3$)—O-2' (and analogs thereof see U.S. Pat. No. 7,399,845, issued on Jul. 15, 2008); 4'-C(CH$_3$)(CH$_3$)—O-2' (and analogs thereof see published International Application WO/2009/006478, published Jan. 8, 2009); 4'-CH$_2$—N(OCH$_3$)-2' (and analogs thereof see published International Application WO/2008/150729, published Dec. 11, 2008); 4'-CH$_2$—O—N(CH$_3$)-2' (see published U.S. Patent Application US2004-0171570, published Sep. 2, 2004); 4'-CH$_2$—N(R)—O-2', wherein R is H, C$_1$-C$_{12}$ alkyl, or a protecting group (see U.S. Pat. No. 7,427,672, issued on Sep. 23, 2008); 4'-CH$_2$—C—(H)(CH$_3$)-2' (see Chattopadhyaya et al., *J. Org. Chem.*, 2009, 74, 118-134); and 4'-CH$_2$—C(=CH$_2$)-2' (and analogs thereof see published International Application WO 2008/154401, published on Dec. 8, 2008).

Further reports related to bicyclic nucleosides can also be found in published literature (see for example: Singh et al., *Chem. Commun.*, 1998, 4, 455-456; Koshkin et al., *Tetrahedron*, 1998, 54, 3607-3630; Wahlestedt et al., *Proc. Natl. Acad. Sci. U.S.A.*, 2000, 97, 5633-5638; Kumar et al., *Bioorg. Med. Chem. Lett.*, 1998, 8, 2219-2222; Singh et al., *J. Org. Chem.*, 1998, 63, 10035-10039; Srivastava et al., *J. Am. Chem. Soc.*, 2007, 129(26) 8362-8379; Elayadi et al., *Curr. Opinion Invest. Drugs*, 2001, 2, 558-561; Braasch et al., *Chem. Biol.*, 2001, 8, 1-7; and Orum et al., *Curr. Opinion Mol. Ther.*, 2001, 3, 239-243; U.S. Pat. Nos. 6,268,490; 6,525,191; 6,670,461; 6,770,748; 6,794,499; 7,034,133; 7,053,207; 7,399,845; 7,547,684; and 7,696,345; U.S. Patent Publication No. US2008-0039618; US2009-0012281; U.S. Patent Ser. Nos. 60/989,574; 61/026,995; 61/026,998; 61/056,564; 61/086,231; 61/097,787; and 61/099,844; Published PCT International applications WO 1994/014226; WO 2004/106356; WO 2005/021570; WO 2007/134181; WO 2008/150729; WO 2008/154401; and WO 2009/006478. Each of the foregoing bicyclic nucleosides can be prepared having one or more stereochemical sugar configurations including for example α-L-ribofuranose and β-D-ribofuranose (see PCT international application PCT/DK98/00393, published on Mar. 25, 1999 as WO 99/14226).

In certain embodiments, bicyclic sugar moieties of BNA nucleosides include, but are not limited to, compounds having at least one bridge between the 4' and the 2' position of the pentofuranosyl sugar moiety wherein such bridges independently comprises 1 or from 2 to 4 linked groups independently selected from —[C(R$_a$)(R$_b$)]$_n$—, —C(R$_a$)=C(R$_b$)—, —C(R$_a$)=N—, —C(=O)—, —C(=NR$_a$)—, —C(=S)—, —O—, —Si(R$_a$)$_2$—, —S(=O)$_x$—, and —N(R$_a$)—;

wherein:

x is 0, 1, or 2;

n is 1, 2, 3, or 4;

each R$_a$ and R$_b$ is, independently, H, a protecting group, hydroxyl, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, heterocycle radical, substituted heterocycle radical, heteroaryl, substituted heteroaryl, C$_5$-C$_7$ alicyclic radical, substituted C$_5$-C$_7$ alicyclic radical, halogen, OJ$_1$, NJ$_1$J$_2$, SJ$_1$, N$_3$, COOJ$_1$, acyl (C(=O)—H), substituted acyl, CN, sulfonyl (S(=O)$_2$-J$_1$), or sulfoxyl (S(=O)-J$_1$); and each J$_1$ and J$_2$ is, independently, H, C$_1$-C$_{12}$ alkyl, substituted C$_1$-C$_{12}$ alkyl, C$_2$-C$_{12}$ alkenyl, substituted C$_2$-C$_{12}$ alkenyl, C$_2$-C$_{12}$ alkynyl, substituted C$_2$-C$_{12}$ alkynyl, C$_5$-C$_{20}$ aryl, substituted C$_5$-C$_{20}$ aryl, acyl (C(=O)—H), substituted acyl, a heterocycle radical, a substituted heterocycle radical, C$_1$-C$_{12}$ aminoalkyl, substituted C$_1$-C$_{12}$ aminoalkyl or a protecting group.

In certain embodiments, the bridge of a bicyclic sugar moiety is —[C(R$_a$)(R$_b$)]$_n$—, —[C(R$_a$)(R$_b$)]$_n$—O—, —C(R$_a$R$_b$)—N(R)—O— or —C(R$_a$R$_b$)—O—N(R)—. In certain embodiments, the bridge is 4'-CH$_2$-2', 4'-(CH$_2$)$_2$-2', 4'-(CH$_2$)$_3$-2', 4'-CH$_2$—O-2', 4'-(CH$_2$)$_2$—O-2', 4'-CH$_2$—O—N(R)-2' and 4'-CH$_2$—N(R)—O-2'- wherein each R is, independently, H, a protecting group or C$_1$-C$_{12}$ alkyl.

In certain embodiments, bicyclic nucleosides are further defined by isomeric configuration. For example, a nucleoside comprising a 4'-2' methylene-oxy bridge, may be in the α-L configuration or in the β-D configuration. Previously, α-L-methyleneoxy (4'-CH$_2$—O-2') BNA's have been incorporated into antisense oligonucleotides that showed antisense activity (Frieden et al., *Nucleic Acids Research*, 2003, 21, 6365-6372).

In certain embodiments, bicyclic nucleosides include, but are not limited to, (A) α-L-methyleneoxy (4'-CH$_2$—O-2') BNA, (B) β-D-methyleneoxy (4'-CH$_2$—O-2') BNA, (C) ethyleneoxy (4'-(CH$_2$)$_2$—O-2') BNA, (D) aminooxy (4'-CH$_2$—O—N(R)-2') BNA, (E) oxyamino (4'-CH$_2$—N(R)—O-2') BNA, and (F) methyl(methyleneoxy) (4'-CH(CH$_3$)—O-2') BNA, (G) methylene-thio (4'-CH$_2$—S-2') BNA, (H) methylene-amino (4'-CH$_2$—N(R)-2') BNA, (I) methyl carbocyclic (4'-CH$_2$—CH(CH$_3$)-2') BNA, (J) propylene carbocyclic (4'-(CH$_2$)$_3$-2') BNA and (K) vinyl BNA as depicted below:

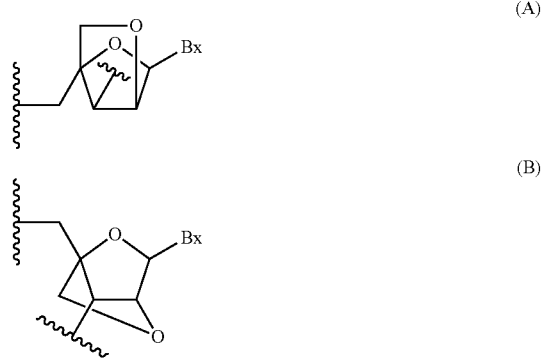

(C) 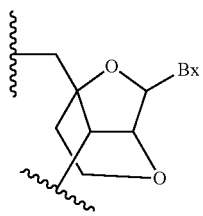

(D) 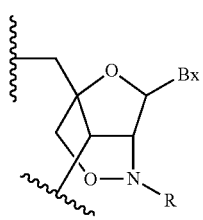

(E) 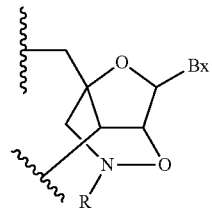

(F) 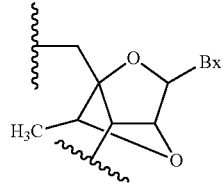

(G) 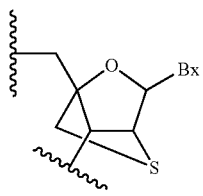

(H) 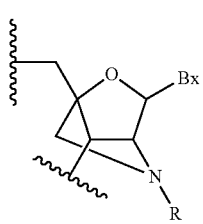

(I) 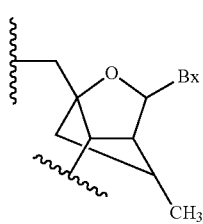

(J) 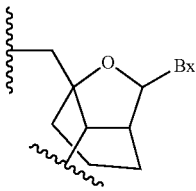

(K) 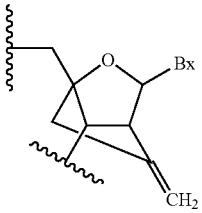

wherein Bx is the base moiety and R is independently H, a protecting group, $C_1$-$C_{12}$ alkyl or $C_1$-$C_{12}$ alkoxy.

In certain embodiments, bicyclic nucleosides are provided having Formula I:

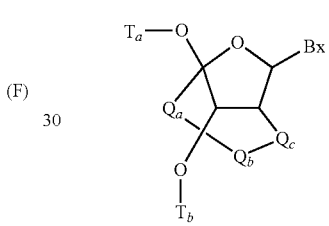

I wherein:
Bx is a heterocyclic base moiety;
-$Q_a$-$Q_b$-$Q_c$- is —$CH_2$—N($R_c$)—$CH_2$—, —C(=O)—N($R_c$)—$CH_2$—, —$CH_2$—O—N($R_c$)—, —$CH_2$—N($R_c$)—O— or —N($R_c$)—O—$CH_2$;
$R_c$ is $C_1$-$C_{12}$ alkyl or an amino protecting group; and
$T_a$ and $T_b$ are each, independently H, a hydroxyl protecting group, a conjugate group, a reactive phosphorus group, a phosphorus moiety or a covalent attachment to a support medium.

In certain embodiments, bicyclic nucleosides are provided having Formula II:

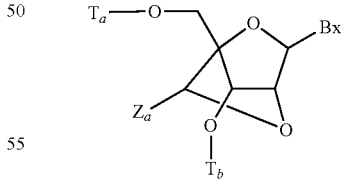

II wherein:
Bx is a heterocyclic base moiety;
$T_a$ and $T_b$ are each, independently H, a hydroxyl protecting group, a conjugate group, a reactive phosphorus group, a phosphorus moiety or a covalent attachment to a support medium;
$Z_a$ is $C_1$-$C_6$ alkyl, $C_2$-$C_6$ alkenyl, $C_2$-$C_6$ alkynyl, substituted $C_1$-$C_6$ alkyl, substituted $C_2$-$C_6$ alkenyl, substituted $C_2$-$C_6$ alkynyl, acyl, substituted acyl, substituted amide, thiol or substituted thio.

In one embodiment, each of the substituted groups is, independently, mono or poly substituted with substituent groups independently selected from halogen, oxo, hydroxyl, $OJ_c$, $NJ_cJ_d$, $SJ_c$, $N_3$, $OC(=X)J_c$, and $NJ_eC(=X)NJ_cJ_d$, wherein each $J_c$, $J_d$ and $J_e$ is, independently, H, $C_1$-$C_6$ alkyl, or substituted $C_1$-$C_6$ alkyl and X is O or $NJ_c$.

In certain embodiments, bicyclic nucleosides are provided having Formula III:

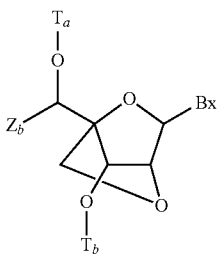

III wherein:

Bx is a heterocyclic base moiety;

$T_a$ and $T_b$ are each, independently H, a hydroxyl protecting group, a conjugate group, a reactive phosphorus group, a phosphorus moiety or a covalent attachment to a support medium;

$Z_b$ is $C_1$-$C_6$ alkyl, $C_2$-$C_6$ alkenyl, $C_2$-$C_6$ alkynyl, substituted $C_1$-$C_6$ alkyl, substituted $C_2$-$C_6$ alkenyl, substituted $C_2$-$C_6$ alkynyl or substituted acyl (C(=O)—).

In certain embodiments, bicyclic nucleosides are provided having Formula IV:

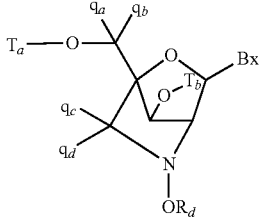

IV wherein:

Bx is a heterocyclic base moiety;

$T_a$ and $T_b$ are each, independently H, a hydroxyl protecting group, a conjugate group, a reactive phosphorus group, a phosphorus moiety or a covalent attachment to a support medium;

$R_d$ is $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl or substituted $C_2$-$C_6$ alkynyl;

each $q_a$, $q_b$, $q_c$ and $q_d$ is, independently, H, halogen, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl or substituted $C_2$-$C_6$ alkynyl, $C_1$-$C_6$ alkoxyl, substituted $C_1$-$C_6$ alkoxyl, acyl, substituted acyl, $C_1$-$C_6$ aminoalkyl or substituted $C_1$-$C_6$ aminoalkyl;

In certain embodiments, bicyclic nucleosides are provided having Formula V:

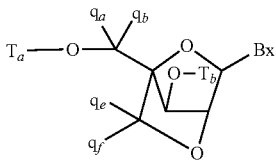

V wherein:

Bx is a heterocyclic base moiety;

$T_a$ and $T_b$ are each, independently H, a hydroxyl protecting group, a conjugate group, a reactive phosphorus group, a phosphorus moiety or a covalent attachment to a support medium;

$q_a$, $q_b$, $q_c$ and $q_f$ are each, independently, hydrogen, halogen, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_1$-$C_{12}$ alkoxy, substituted $C_1$-$C_{12}$ alkoxy, $OJ_j$, $SJ_j$, $SOJ_j$, $SO_2J_j$, $NJ_jJ_k$, $N_3$, CN, C(=O)$OJ_j$, C(=O) $NJ_jJ_k$, C(=O)$J_j$, O—C(=O)—$NJ_jJ_k$, N(H)C(=NH)$NJ_jJ_k$, N(H)C(=O)$NJ_jJ_k$ or N(H)C(=S)$NJ_jJ_k$;

or $q_e$ and $q_f$ together are =C($q_g$)($q_h$);

$q_g$ and $q_h$ are each, independently, H, halogen, $C_1$-$C_{12}$ alkyl or substituted $C_1$-$C_{12}$ alkyl.

The synthesis and preparation of the methyleneoxy (4'-$CH_2$—O-2') BNA monomers adenine, cytosine, guanine, 5-methyl-cytosine, thymine and uracil, along with their oligomerization, and nucleic acid recognition properties have been described (Koshkin et al., *Tetrahedron,* 1998, 54, 3607-3630). BNAs and preparation thereof are also described in WO 98/39352 and WO 99/14226.

Analogs of methyleneoxy (4'-$CH_2$—O-2') BNA and 2'-thio-BNAs, have also been prepared (Kumar et al., *Bioorg. Med. Chem. Lett.,* 1998, 8, 2219-2222). Preparation of locked nucleoside analogs comprising oligodeoxyribonucleotide duplexes as substrates for nucleic acid polymerases has also been described (Wengel et al., WO 99/14226). Furthermore, synthesis of 2'-amino-BNA, a novel comformationally restricted high-affinity oligonucleotide analog has been described in the art (Singh et al., *J. Org. Chem.,* 1998, 63, 10035-10039). In addition, 2'-amino- and 2'-methylamino-BNA's have been prepared and the thermal stability of their duplexes with complementary RNA and DNA strands has been previously reported.

In certain embodiments, bicyclic nucleosides are provided having Formula VI:

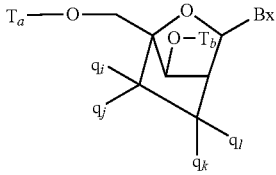

VI wherein:

Bx is a heterocyclic base moiety;

$T_a$ and $T_b$ are each, independently H, a hydroxyl protecting group, a conjugate group, a reactive phosphorus group, a phosphorus moiety or a covalent attachment to a support medium;

each $q_i$, $q_j$, $q_k$ and $q_l$ is, independently, H, halogen, $C_1$-$C_{12}$ alkyl, substituted $C_1$-$C_{12}$ alkyl, $C_2$-$C_{12}$ alkenyl, substituted $C_2$-$C_{12}$ alkenyl, $C_2$-$C_{12}$ alkynyl, substituted $C_2$-$C_{12}$ alkynyl, $C_1$-$C_{12}$ alkoxyl, substituted $C_1$-$C_{12}$ alkoxyl, $OJ_j$, $SJ_j$, $SOJ_j$, $NJ_jJ_k$, $N_3$, CN, C(=O)$OJ_j$, C(=O)$NJ_jJ_k$, C(=O)$J_j$, O—C(=O)$NJ_jJ_k$, N(H)C(=NH)$NJ_jJ_k$, N(H)C(=O)$NJ_jJ_k$ or N(H)C(=S)$NJ_jJ_k$; and $q_i$ and $q_j$ or $q_l$ and $q_k$ together are =C($q_g$)($q_h$), wherein $q_g$ and $q_h$ are each, independently, H, halogen, $C_1$-$C_{12}$ alkyl or substituted $C_1$-$C_{12}$ alkyl.

One carbocyclic bicyclic nucleoside having a 4'-(CH$_2$)$_3$-2' bridge and the alkenyl analog bridge 4'-CH=CH—CH$_2$-2' have been described (Freier et al., *Nucleic Acids Research*, 1997, 25(22), 4429-4443 and Albaek et al., *J. Org. Chem.*, 2006, 71, 7731-7740). The synthesis and preparation of carbocyclic bicyclic nucleosides along with their oligomerization and biochemical studies have also been described (Srivastava et al., *J. Am. Chem. Soc.*, 2007, 129(26), 8362-8379).

As used herein, "4'-2' bicyclic nucleoside" or "4' to 2' bicyclic nucleoside" refers to a bicyclic nucleoside comprising a furanose ring comprising a bridge connecting two carbon atoms of the furanose ring connects the 2' carbon atom and the 4' carbon atom of the sugar ring.

As used herein, "monocylic nucleosides" refer to nucleosides comprising modified sugar moieties that are not bicyclic sugar moieties. In certain embodiments, the sugar moiety, or sugar moiety analogue, of a nucleoside may be modified or substituted at any position.

As used herein, "2'-modified sugar" means a furanosyl sugar modified at the 2' position. In certain embodiments, such modifications include substituents selected from: a halide, including, but not limited to substituted and unsubstituted alkoxy, substituted and unsubstituted thioalkyl, substituted and unsubstituted amino alkyl, substituted and unsubstituted alkyl, substituted and unsubstituted allyl, and substituted and unsubstituted alkynyl. In certain embodiments, 2' modifications are selected from substituents including, but not limited to: O[(CH$_2$)$_n$O]$_m$CH$_3$, O(CH$_2$)$_n$—NH$_2$, O(CH$_2$)$_n$—CH$_3$, O(CH$_2$)$_n$—F, O(CH$_2$)$_n$—ONH$_2$, OCH$_2$C(=O)N(H)CH$_3$, and O(CH$_2$)$_n$ON[(CH$_2$)$_n$—CH$_3$]$_2$, where n and m are from 1 to about 10. Other 2'-substituent groups can also be selected from: $C_1$-$C_{12}$ alkyl, substituted alkyl, alkenyl, alkynyl, alkaryl, aralkyl, O-alkaryl or O-aralkyl, SH, SCH$_3$, OCN, Cl, Br, CN, F, CF$_3$, OCF$_3$, SOCH$_3$, SO$_2$CH$_3$, ONO$_2$, NO$_2$, N$_3$, NH$_2$, heterocycloalkyl, heterocycloalkaryl, aminoalkylamino, polyalkylamino, substituted silyl, an RNA cleaving group, a reporter group, an intercalator, a group for improving pharmacokinetic properties, or a group for improving the pharmacodynamic properties of an antisense compound, and other substituents having similar properties. In certain embodiments, modified nucleosides comprise a 2'-MOE side chain (Baker et al., *J. Biol. Chem.*, 1997, 272, 11944-12000). Such 2'-MOE substitution have been described as having improved binding affinity compared to unmodified nucleosides and to other modified nucleosides, such as 2'-O-methyl, O-propyl, and O-aminopropyl. Oligonucleotides having the 2'-MOE substituent also have been shown to be antisense inhibitors of gene expression with promising features for in vivo use (Martin, *Helv. Chim. Acta*, 1995, 78, 486-504; Altmann et al., *Chimia*, 1996, 50, 168-176; Altmann et al., *Biochem. Soc. Trans.*, 1996, 24, 630-637; and Altmann et al., *Nucleosides Nucleotides*, 1997, 16, 917-926).

As used herein, a "modified tetrahydropyran nucleoside" or "modified THP nucleoside" means a nucleoside having a six-membered tetrahydropyran "sugar" substituted in for the pentofuranosyl residue in normal nucleosides (a sugar surrogate). Modified THP nucleosides include, but are not limited to, what is referred to in the art as hexitol nucleic acid (HNA), anitol nucleic acid (ANA), mannitol nucleic acid (MNA) (see Leumann, *Bioorg. Med. Chem.*, 2002, 10, 841-854) or fluoro HNA (F-HNA) having a tetrahydropyran ring system as illustrated below:

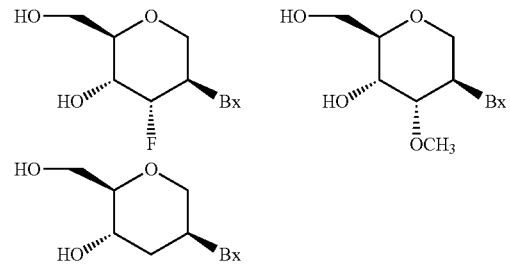

In certain embodiments, sugar surrogates are selected having Formula VII:

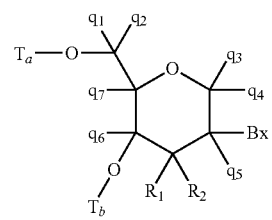

VII wherein independently for each of said at least one tetrahydropyran nucleoside analog of Formula VII:

Bx is a heterocyclic base moiety;

$T_a$ and $T_b$ are each, independently, an internucleoside linking group linking the tetrahydropyran nucleoside analog to the antisense compound or one of $T_a$ and $T_b$ is an internucleoside linking group linking the tetrahydropyran nucleoside analog to the antisense compound and the other of $T_a$ and $T_b$ is H, a hydroxyl protecting group, a linked conjugate group or a 5' or 3'-terminal group;

$q_1$, $q_2$, $q_3$, $q_4$, $q_5$, $q_6$ and $q_7$ are each independently, H, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl or substituted $C_2$-$C_6$ alkynyl; and each of $R_1$ and $R_2$ is selected from hydrogen, hydroxyl, halogen, substituted or unsubstituted alkoxy, $NJ_1J_2$, $SJ_1$, $N_3$, OC(=X)$J_1$, OC(=X)$NJ_1J_2$, $NJ_3$C(=X)$NJ_1J_2$ and CN, wherein X is O, S or $NJ_1$ and each $J_1$, $J_2$ and $J_3$ is, independently, H or $C_1$-$C_6$ alkyl.

In certain embodiments, the modified THP nucleosides of Formula VII are provided wherein $q_1$, $q_2$, $q_3$, $q_4$, $q_5$, $q_6$ and $q_7$ are each H. In certain embodiments, at least one of $q_1$, $q_2$, $q_3$, $q_4$, $q_5$, $q_6$ and $q_7$ is other than H. In certain embodiments, at least one of $q_1$, $q_2$, $q_3$, $q_4$, $q_5$, $q_6$ and $q_7$ is methyl. In certain embodiments, THP nucleosides of Formula VII are provided wherein one of $R_1$ and $R_2$ is fluoro. In certain embodiments, $R_1$ is fluoro and $R_2$ is H; $R_1$ is methoxy and $R_2$ is H, and $R_1$ is methoxyethoxy and $R_2$ is H.

In certain embodiments, sugar surrogates comprise rings having more than 5 atoms and more than one heteroatom. For example nucleosides comprising morpholino sugar moieties and their use in oligomeric compounds has been reported (see for example: Braasch et al., *Biochemistry*, 2002, 41, 4503-4510; and U.S. Pat. Nos. 5,698,685; 5,166, 315; 5,185,444; and 5,034,506). As used here, the term "morpholino" means a sugar surrogate having the following formula:

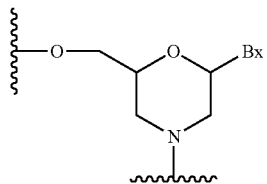

In certain embodiments, morpholinos may be modified, for example by adding or altering various substituent groups from the above morpholino structure. Such sugar surrogates are referred to herein as "modified morpholinos."

Combinations of modifications are also provided without limitation, such as 2'-F-5'-methyl substituted nucleosides (see PCT International Application WO 2008/101157 published on Aug. 21, 2008 for other disclosed 5',2'-bis substituted nucleosides) and replacement of the ribosyl ring oxygen atom with S and further substitution at the 2'-position (see published U.S. Patent Application US2005-0130923, published on Jun. 16, 2005) or alternatively 5'-substitution of a bicyclic nucleic acid (see PCT International Application WO 2007/134181, published on Nov. 22, 2007 wherein a 4'-CH$_2$—O-2' bicyclic nucleoside is further substituted at the 5' position with a 5'-methyl or a 5'-vinyl group). The synthesis and preparation of carbocyclic bicyclic nucleosides along with their oligomerization and biochemical studies have also been described (see, e.g., Srivastava et al., *J. Am. Chem. Soc.* 2007, 129(26), 8362-8379).

In certain embodiments, antisense compounds comprise one or more modified cyclohexenyl nucleosides, which is a nucleoside having a six-membered cyclohexenyl in place of the pentofuranosyl residue in naturally occurring nucleosides. Modified cyclohexenyl nucleosides include, but are not limited to those described in the art (see for example commonly owned, published PCT Application WO 2010/036696, published on Apr. 10, 2010, Robeyns et al., *J. Am. Chem. Soc.*, 2008, 130(6), 1979-1984; Horváth et al., *Tetrahedron Letters*, 2007, 48, 3621-3623; Nauwelaerts et al., *J. Am. Chem. Soc.*, 2007, 129(30), 9340-9348; Gu et al., *Nucleosides, Nucleotides & Nucleic Acids*, 2005, 24(5-7), 993-998; Nauwelaerts et al., *Nucleic Acids Research*, 2005, 33(8), 2452-2463; Robeyns et al., *Acta Crystallographica, Section F: Structural Biology and Crystallization Communications*, 2005, F61(6), 585-586; Gu et al., *Tetrahedron*, 2004, 60(9), 2111-2123; Gu et al., *Oligonucleotides*, 2003, 13(6), 479-489; Wang et al., *J. Org. Chem.*, 2003, 68, 4499-4505; Verbeure et al., *Nucleic Acids Research*, 2001, 29(24), 4941-4947; Wang et al., *J. Org. Chem.*, 2001, 66, 8478-82; Wang et al., *Nucleosides, Nucleotides & Nucleic Acids*, 2001, 20(4-7), 785-788; Wang et al., *J. Am. Chem.*, 2000, 122, 8595-8602; Published PCT application, WO 06/047842; and Published PCT Application WO 01/049687; the text of each is incorporated by reference herein, in their entirety). Certain modified cyclohexenyl nucleosides have Formula X.

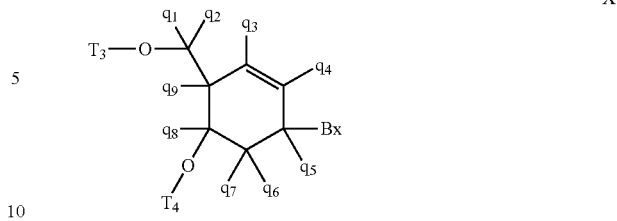

wherein independently for each of said at least one cyclohexenyl nucleoside analog of Formula X:

Bx is a heterocyclic base moiety;

$T_3$ and $T_4$ are each, independently, an internucleoside linking group linking the cyclohexenyl nucleoside analog to an antisense compound or one of $T_3$ and $T_4$ is an internucleoside linking group linking the tetrahydropyran nucleoside analog to an antisense compound and the other of $T_3$ and $T_4$ is H, a hydroxyl protecting group, a linked conjugate group, or a 5'- or 3'-terminal group; and $q_1$, $q_2$, $q_3$, $q_4$, $q_5$, $q_6$, $q_7$, $q_8$ and $q_9$ are each, independently, H, $C_1$-$C_6$ alkyl, substituted $C_1$-$C_6$ alkyl, $C_2$-$C_6$ alkenyl, substituted $C_2$-$C_6$ alkenyl, $C_2$-$C_6$ alkynyl, substituted $C_2$-$C_6$ alkynyl or other sugar substituent group.

As used herein, "2'-modified" or "2'-substituted" refers to a nucleoside comprising a sugar comprising a substituent at the 2' position other than H or OH. 2'-modified nucleosides, include, but are not limited to, bicyclic nucleosides wherein the bridge connecting two carbon atoms of the sugar ring connects the 2' carbon and another carbon of the sugar ring; and nucleosides with non-bridging 2'substituents, such as allyl, amino, azido, thio, O-allyl, O—$C_1$-$C_{10}$ alkyl, —OCF$_3$, O—(CH$_2$)$_2$—O—CH$_3$, 2'-O(CH$_2$)$_2$SCH$_3$, O—(CH$_2$)$_2$—O—N(R$_m$)(R$_n$), or O—CH$_2$—C(=O)—N(R$_m$)(R$_n$), where each R$_m$ and R$_n$ is, independently, H or substituted or unsubstituted $C_1$-$C_{10}$ alkyl. 2'-modified nucleosides may further comprise other modifications, for example at other positions of the sugar and/or at the nucleobase.

As used herein, "2'-F" refers to a nucleoside comprising a sugar comprising a fluoro group at the 2' position of the sugar ring.

As used herein, "2'-OMe" or "2'-OCH$_3$" or "2'-O-methyl" each refers to a nucleoside comprising a sugar comprising an —OCH$_3$ group at the 2' position of the sugar ring.

As used herein, "MOE" or "2'-MOE" or "2'-OCH$_2$CH$_2$OCH$_3$" or "2'-O-methoxyethyl" each refers to a nucleoside comprising a sugar comprising a —OCH$_2$CH$_2$OCH$_3$ group at the 2' position of the sugar ring.

As used herein, "oligonucleotide" refers to a compound comprising a plurality of linked nucleosides. In certain embodiments, one or more of the plurality of nucleosides is modified. In certain embodiments, an oligonucleotide comprises one or more ribonucleosides (RNA) and/or deoxyribonucleosides (DNA).

Many other bicyclo and tricyclo sugar surrogate ring systems are also known in the art that can be used to modify nucleosides for incorporation into antisense compounds (see for example review article: Leumann, *Bioorg. Med. Chem.*, 2002, 10, 841-854). Such ring systems can undergo various additional substitutions to enhance activity.

Methods for the preparations of modified sugars are well known to those skilled in the art. Some representative U.S. patents that teach the preparation of such modified sugars include without limitation, U.S. Pat. Nos. 4,981,957; 5,118, 800; 5,319,080; 5,359,044; 5,393,878; 5,446,137; 5,466, 786; 5,514,785; 5,519,134; 5,567,811; 5,576,427; 5,591,722; 5,597,909; 5,610,300; 5,627,053; 5,639,873; 5,646,265; 5,670,633; 5,700,920; 5,792,847 and 6,600,032 and International Application PCT/US2005/019219, filed Jun. 2, 2005 and published as WO 2005/121371 on Dec. 22, 2005, and each of which is herein incorporated by reference in its entirety.

In nucleotides having modified sugar moieties, the nucleobase moieties (natural, modified or a combination thereof) are maintained for hybridization with an appropriate nucleic acid target.

In certain embodiments, antisense compounds comprise one or more nucleosides having modified sugar moieties. In certain embodiments, the modified sugar moiety is 2'-MOE. In certain embodiments, the 2'-MOE modified nucleosides are arranged in a gapmer motif. In certain embodiments, the modified sugar moiety is a bicyclic nucleoside having a (4'-CH(CH$_3$)—O-2') bridging group. In certain embodiments, the (4'-CH(CH$_3$)—O-2') modified nucleosides are arranged throughout the wings of a gapmer motif.

Modified Nucleobases

Nucleobase (or base) modifications or substitutions are structurally distinguishable from, yet functionally interchangeable with, naturally occurring or synthetic unmodified nucleobases. Both natural and modified nucleobases are capable of participating in hydrogen bonding. Such nucleobase modifications can impart nuclease stability, binding affinity or some other beneficial biological property to antisense compounds. Modified nucleobases include synthetic and natural nucleobases such as, for example, 5-methylcytosine (5-me-C). Certain nucleobase substitutions, including 5-methylcytosine substitutions, are particularly useful for increasing the binding affinity of an antisense compound for a target nucleic acid. For example, 5-methylcytosine substitutions have been shown to increase nucleic acid duplex stability by 0.6-1.2° C. (Sanghvi, Y. S., Crooke, S. T. and Lebleu, B., eds., Antisense Research and Applications, CRC Press, Boca Raton, 1993, pp. 276-278).

Additional modified nucleobases include 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl (—C≡C—CH3) uracil and cytosine and other alkynyl derivatives of pyrimidine bases, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylguanine and 7-methyladenine, 2-F-adenine, 2-amino-adenine, 8-azaguanine and 8-azaadenine, 7-deazaguanine and 7-deazaadenine and 3-deazaguanine and 3-deazaadenine.

Heterocyclic base moieties can also include those in which the purine or pyrimidine base is replaced with other heterocycles, for example 7-deaza-adenine, 7-deazaguanosine, 2-aminopyridine and 2-pyridone. Nucleobases that are particularly useful for increasing the binding affinity of antisense compounds include 5-substituted pyrimidines, 6-azapyrimidines and N-2, N-6 and O-6 substituted purines, including 2 aminopropyladenine, 5-propynyluracil and 5-propynylcytosine.

In certain embodiments, antisense compounds targeted to UBE3A-ATS comprise one or more modified nucleobases. In certain embodiments, shortened or gap-widened antisense oligonucleotides targeted to UBE3A-ATS comprise one or more modified nucleobases. In certain embodiments, the modified nucleobase is 5-methylcytosine. In certain embodiments, each cytosine is a 5-methylcytosine.

Conjugated Antisense Compounds

Antisense compounds may be covalently linked to one or more moieties or conjugates which enhance the activity, cellular distribution or cellular uptake of the resulting antisense oligonucleotides. Typical conjugate groups include cholesterol moieties and lipid moieties. Additional conjugate groups include carbohydrates, phospholipids, biotin, phenazine, folate, phenanthridine, anthraquinone, acridine, fluoresceins, rhodamines, coumarins, and dyes.

Antisense compounds can also be modified to have one or more stabilizing groups that are generally attached to one or both termini of antisense compounds to enhance properties such as, for example, nuclease stability. Included in stabilizing groups are cap structures. These terminal modifications protect the antisense compound having terminal nucleic acid from exonuclease degradation, and can help in delivery and/or localization within a cell. The cap can be present at the 5'-terminus (5'-cap), or at the 3'-terminus (3'-cap), or can be present on both termini. Cap structures are well known in the art and include, for example, inverted deoxy abasic caps. Further 3' and 5'-stabilizing groups that can be used to cap one or both ends of an antisense compound to impart nuclease stability include those disclosed in WO 03/004602 published on Jan. 16, 2003.

In certain embodiments, antisense compounds, including, but not limited to those particularly suited for use as ssRNA, are modified by attachment of one or more conjugate groups. In general, conjugate groups modify one or more properties of the attached oligonucleotide, including but not limited to pharmacodynamics, pharmacokinetics, stability, binding, absorption, cellular distribution, cellular uptake, charge and clearance. Conjugate groups are routinely used in the chemical arts and are linked directly or via an optional conjugate linking moiety or conjugate linking group to a parent compound such as an oligonucleotide. Conjugate groups includes without limitation, intercalators, reporter molecules, polyamines, polyamides, polyethylene glycols, thioethers, polyethers, cholesterols, thiocholesterols, cholic acid moieties, folate, lipids, phospholipids, biotin, phenazine, phenanthridine, anthraquinone, adamantane, acridine, fluoresceins, rhodamines, coumarins and dyes. Certain conjugate groups have been described previously, for example: cholesterol moiety (Letsinger et al., Proc. Natl. Acad. Sci. USA, 1989, 86, 6553-6556), cholic acid (Manoharan et al., Bioorg. Med. Chem. Let., 1994, 4, 1053-1060), a thioether, e.g., hexyl-S-tritylthiol (Manoharan et al., Ann. N.Y. Acad. Sci., 1992, 660, 306-309; Manoharan et al., Bioorg. Med. Chem. Let., 1993, 3, 2765-2770), a thiocholesterol (Oberhauser et al., Nucl. Acids Res., 1992, 20, 533-538), an aliphatic chain, e.g., do-decan-diol or undecyl residues (Saison-Behmoaras et al., EMBO J., 1991, 10, 1111-1118; Kabanov et al., FEBS Lett., 1990, 259, 327-330; Svinarchuk et al., Biochimie, 1993, 75, 49-54), a phospholipid, e.g., di-hexadecyl-rac-glycerol or triethyl-ammonium 1,2-di-O-hexadecyl-rac-glycero-3-H-phosphonate (Manoharan et al., Tetrahedron Lett., 1995, 36, 3651-3654; Shea et al., Nucl. Acids Res., 1990, 18, 3777-3783), a polyamine or a polyethylene glycol chain (Manoharan et al., Nucleosides & Nucleotides, 1995, 14, 969-973), or adamantane acetic acid (Manoharan et al., Tetrahedron Lett., 1995, 36, 3651-3654), a palmityl moiety (Mishra et al., Biochim. Biophys. Acta, 1995, 1264, 229-237), or an octadecylamine or hexylamino-carbonyl-oxycholesterol moiety (Crooke et al., J. Pharmacol. Exp. Ther., 1996, 277, 923-937).

For additional conjugates including those useful for ssRNA and their placement within antisense compounds, see e.g., U.S. Application No. 61/583,963.

In Vitro Testing of Antisense Oligonucleotides

Described herein are methods for treatment of cells with antisense oligonucleotides, which can be modified appropriately for treatment with other antisense compounds.

Cells may be treated with antisense oligonucleotides when the cells reach approximately 60-80% confluency in culture.

One reagent commonly used to introduce antisense oligonucleotides into cultured cells includes the cationic lipid transfection reagent LIPOFECTIN (Invitrogen, Carlsbad, Calif.). Antisense oligonucleotides may be mixed with LIPOFECTIN in OPTI-MEM 1 (Invitrogen, Carlsbad, Calif.) to achieve the desired final concentration of antisense oligonucleotide and a LIPOFECTIN concentration that may range from 2 to 12 ug/mL per 100 nM antisense oligonucleotide.

Another reagent used to introduce antisense oligonucleotides into cultured cells includes LIPOFECTAMINE (Invitrogen, Carlsbad, Calif.). Antisense oligonucleotide is mixed with LIPOFECTAMINE in OPTI-MEM 1 reduced serum medium (Invitrogen, Carlsbad, Calif.) to achieve the desired concentration of antisense oligonucleotide and a LIPOFECTAMINE concentration that may range from 2 to 12 ug/mL per 100 nM antisense oligonucleotide.

Another technique used to introduce antisense oligonucleotides into cultured cells includes electroporation.

Yet another technique used to introduce antisense oligonucleotides into cultured cells includes free uptake of the oligonucleotides by the cells.

Cells are treated with antisense oligonucleotides by routine methods. Cells may be harvested 16-24 hours after antisense oligonucleotide treatment, at which time RNA or protein levels of target nucleic acids are measured by methods known in the art and described herein. In general, when treatments are performed in multiple replicates, the data are presented as the average of the replicate treatments.

The concentration of antisense oligonucleotide used varies from cell line to cell line. Methods to determine the optimal antisense oligonucleotide concentration for a particular cell line are well known in the art. Antisense oligonucleotides are typically used at concentrations ranging from 1 nM to 300 nM when transfected with LIPOFECTAMINE. Antisense oligonucleotides are used at higher concentrations ranging from 625 to 20,000 nM when transfected using electroporation.

RNA Isolation

RNA analysis can be performed on total cellular RNA or poly(A)+mRNA. Methods of RNA isolation are well known in the art. RNA is prepared using methods well known in the art, for example, using the TRIZOL Reagent (Invitrogen, Carlsbad, Calif.) according to the manufacturer's recommended protocols.

EXAMPLES

Non-Limiting Disclosure and Incorporation by Reference

While certain compounds, compositions and methods described herein have been described with specificity in accordance with certain embodiments, the following examples serve only to illustrate the compounds described herein and are not intended to limit the same. Each of the references recited in the present application is incorporated herein by reference in its entirety.

Example 1

Antisense Inhibition of the Antisense Sequence of Ubiquitin Protein Ligase E3A (Ube3a-ATS) in Primary Neuronal Cells Antisense oligonucleotides were designed targeting the mouse sequence immediately downstream of MBII-52 snoRNA to the beginning of Ube3a antisense sequence, described herein as nucleotides 997469 to 1110944 of SEQ ID NO: 1 and were tested for their effects on up-regulating the expression of the paternal allele of Ube3a in vitro.

The newly designed chimeric antisense oligonucleotides in Table 1 were designed as 5-10-5 MOE gapmers. The gapmers are 20 nucleosides in length, wherein the central gap segment comprises of ten 2'-deoxynucleosides and is flanked by wing segments on the 5' direction and the 3' direction comprising five nucleosides each. Each nucleoside in the 5' wing segment and each nucleoside in the 3' wing segment has a 2'-MOE modification. The internucleoside linkages throughout each gapmer are phosphorothioate (P=S) linkages. All cytosine residues throughout each gapmer are 5-methylcytosines.

Primary cultures of hippocampal and cortical neurons were obtained from P0-P2 Ube3a+/YFP offspring of C57BL/6 female mice crossed to Ube3a-YFP male mice (Dindot, S. V. et al., Hum. Mol. Genet. 2008. 17: 111-118). Chopped cortical hemispheres were digested with 0.25% trypsin and mechanically dissociated. Neurons were cultured in a Neurobasal Medium (Invitrogen, Carlsbad, Calif.) supplemented with B27 (Invitrogen) on plates coated with poly-D-lysine (Sigma-Aldrich, St Louis, Mo.). Half of the medium was changed at day 4 and the culture was further maintained for 3 more days at 37° C. in 5% $CO_2$. Sets of cell culture were treated with antisense oligonucleotides by free uptake at a final concentration of 15 μM in the presence of Ara-C to inhibit glial proliferation. A set of cells treated with PBS was used as the untreated control.

Three days after antisense oligonucleotide treatment, cells were fixed with 4% paraformaldehyde for 1 hr. The cells were then washed three times with PBS, and blocked with 5% goat serum (Sigma-Aldrich, St Louis, Mo.) for 1 hr at room temperature. The cells were co-stained with anti-GFP (NB600-308, Novus Biologicals, Littleton, Colo.) at 1:2,500 dilution and anti-NeuN (MAB377, Millipore, Billerica, Mass.) at 1:500 dilution at 4° C. overnight in a humidified chamber with gentle agitation. After three washed in 0.5% Tween-20 in PBS, the cells were stained with secondary goat anti-rabbit antibody conjugated with Alexa Fluor 488 or goat anti-mouse antibody conjugated with Alexa Fluor 555 (Invitrogen, Carlsbad, Calif.) both at 1:1000 dilution. After washes, the plates were imaged with Texas Red and FITC channel by ImageXpress$^{Ultra}$ confocal system (Molecular Device) with a 20× objective. The laser power was manually set for each plate to avoid fluorescence saturation in the samples. Nine images were taken from each well. The images were then processed with the MetaXpress software (Molecular Device) to quantify FITC intensity in those Texas Red positive cells. Typically 200-800 cells were scored per well and the signal intensity was averaged, and normalized to untransfected control cells.

Forty-three antisense oligonucleotides targeting unique sites within the region antisense to the Ube3a pre-mRNA at nucleotides 1032967 to 1110944 of SEQ ID NO: 1) were tested for their effect on inducing expression of Ube3a protein, as quantified by fluorescence. The average induction of the protein after treatment with these ASOs was 18% over the untreated control. A hundred and seventy six oligonucleotides targeting unique sites within the nucleotide region immediately downstream of MBII-52 snoRNA and upstream of the region antisense to the Ube3a pre-mRNA (nucleotides 997469 to 1032966 of SEQ ID NO: 1), designated in the Tables as the 'hotspot', were also tested for their effect on inducing expression of Ube3a-YFP protein. The average induction of the protein after treatment with these ASOs was 83% over the untreated control. The results of the complete screening of the antisense oligonucleotides are presented in Tables 1-3; each Table represents each screening plate utilized. '% induction' is expressed as the percent induction of the protein over the untreated control. "Target start site" indicates the 5'-most nucleotide to which the gapmer is targeted on SEQ ID NO: 1. "Target stop site" indicates the 3'-most nucleotide to which the gapmer is targeted on SEQ ID NO: 1.

TABLE 1

| Target Start Site | Target Stop Site | Region | Sequence | ISIS No | % upregulation | SEQ ID NO |
|---|---|---|---|---|---|---|
| 1003255 | 1003274 | hotspot | GTTATACACACATATATTTT | 592429 | 0 | 7 |
| 1003431 | 1003450 | hotspot | TAGCTTAAACACACTTTTTC | 592430 | 25 | 8 |
| 1003601 | 1003620 | hotspot | ATATGTTGGTCAGCTACTAC | 592431 | 81 | 9 |
| 1003801 | 1003820 | hotspot | GTATATCCTTCCAGATCCTT | 592432 | 157 | 10 |
| 1003971 | 1003990 | hotspot | TGAGTTCATTGGCACATTCA | 592433 | 102 | 11 |
| 1004144 | 1004163 | hotspot | CTAGAAGGTGATATGAGGAT | 592434 | 59 | 12 |
| 1004318 | 1004337 | hotspot | ATAAATATTTCTGCATATTG | 592435 | 2 | 13 |
| 1004488 | 1004507 | hotspot | CATGTACATCCCTATACCTG | 592436 | 126 | 14 |
| 1004658 | 1004677 | hotspot | GACACTTTTCTTGCATAAAT | 592437 | 67 | 15 |
| 1004833 | 1004852 | hotspot | GTCAAAATAGTTATTTTGGG | 592438 | 38 | 16 |
| 1005007 | 1005026 | hotspot | AAAATTTTTATCTCAGCTAC | 592439 | 4 | 17 |
| 1005178 | 1005197 | hotspot | TAAGAAGTAAGCAACTAGGG | 592440 | 54 | 18 |
| 1005348 | 1005367 | hotspot | AGCACATGCAATGATTAGAT | 592441 | 95 | 19 |
| 1005518 | 1005537 | hotspot | ACAATATATATTTTGAAACT | 592442 | 0 | 20 |
| 1005688 | 1005707 | hotspot | CAAGATGGAGAATTCTTGGC | 592443 | 9 | 21 |
| 1005858 | 1005877 | hotspot | TGAATATGCTTGACCCATAG | 592444 | 161 | 22 |
| 1006028 | 1006047 | hotspot | TTCCTTTGTGTAAATGTACC | 592445 | 72 | 23 |
| 1006245 | 1006264 | hotspot | TCAAGCATACTTGGGCCTTC | 592446 | 135 | 24 |
| 1006420 | 1006439 | hotspot | AACACCTGGCAGCTGCATAC | 592447 | 97 | 25 |
| 1006590 | 1006609 | hotspot | TGTTAGTGTCCCTATCCGTC | 592448 | 158 | 26 |
| 1006760 | 1006779 | hotspot | CTGCAAGAACAGCATAGCAT | 592449 | 89 | 27 |
| 1006930 | 1006949 | hotspot | CAAAGGTCCAGGTTAGTTGA | 592450 | 41 | 28 |
| 1007104 | 1007123 | hotspot | TTTCAGGCCCCACCCTCGGG | 592451 | 73 | 29 |
| 1007275 | 1007294 | hotspot | AGGTCCAACATCTTTCTTTC | 592452 | 140 | 30 |
| 1007483 | 1007502 | hotspot | AATATGCTGGTCAAGCCTTC | 592453 | 97 | 31 |
| 1007699 | 1007718 | hotspot | AATGCAGTTTGCTATGGCTC | 592454 | 110 | 32 |
| 1007869 | 1007888 | hotspot | GGTTGTGAGCAACCATGTGG | 592455 | 92 | 33 |
| 1008047 | 1008066 | hotspot | ATTATATGATTGCATTTGAA | 592456 | 12 | 34 |
| 1008230 | 1008249 | hotspot | CATAGATGTTAAATTGTTAA | 592457 | 0 | 35 |
| 1008581 | 1008600 | hotspot | ATGTGATCTTTTAAGATGTA | 592459 | 13 | 36 |
| 1008751 | 1008770 | hotspot | CATGAACAGTTATTCATTAT | 592460 | 32 | 37 |
| 1009091 | 1009110 | hotspot | GCTATTTTCCTAGGAGCATT | 592461 | 68 | 38 |

TABLE 1-continued

| Target Start Site | Target Stop Site | Region | Sequence | ISIS No | % upregulation | SEQ ID NO |
|---|---|---|---|---|---|---|
| 1009262 | 1009281 | hotspot | GAAGTGTTTTAAGGTTTTCA | 592462 | 0 | 39 |
| 1009604 | 1009623 | hotspot | AACCCAGTAATACTGAGCGC | 592464 | 92 | 40 |
| 1009790 | 1009809 | hotspot | TGGATCCTCAGGTGCGACTC | 592465 | 80 | 41 |
| 1010033 | 1010052 | hotspot | GTACTGGTTAATTAATATTG | 592466 | 6 | 42 |
| 1010298 | 1010317 | hotspot | ATTTCAAGTGTTATCCCCTT | 592467 | 192 | 43 |
| 1010468 | 1010487 | hotspot | TATTGAAAATGTGAATCACT | 592468 | 31 | 44 |
| 1010638 | 1010657 | hotspot | GTTTTATCAGAATGGCTCTA | 592469 | 138 | 45 |
| 1010808 | 1010827 | hotspot | CACCATTTATTAAAGATGTT | 592470 | 36 | 46 |
| 1010978 | 1010997 | hotspot | CCTGCAGAGGTATCTGAACC | 592471 | 70 | 47 |
| 1011152 | 1011171 | hotspot | TTAAATAAAGCCTTTATTAA | 592472 | 1 | 48 |
| 1011331 | 1011350 | hotspot | TGAAACAGCTGAGCAATCTC | 592473 | 108 | 49 |
| 1011707 | 1011726 | hotspot | TTTAACCACAATTGTTCTGG | 592475 | 84 | 50 |
| 1011877 | 1011896 | hotspot | TAGAGGTAGCCTTTCTGATG | 592476 | 132 | 51 |
| 1012050 | 1012069 | hotspot | AGTCCCAGAGATCCTACCTG | 592477 | 117 | 52 |
| 1012220 | 1012239 | hotspot | GTGTGTGCAAATGGAGGCTA | 592478 | 55 | 53 |
| 1012404 | 1012423 | hotspot | ATGGTAGTTGTAATTTTCGG | 592479 | 93 | 54 |
| 1012579 | 1012598 | hotspot | AAATGTGATCATTTTACTCT | 592480 | 50 | 55 |
| 1012751 | 1012770 | hotspot | GTTCTACTTTAATCACATTC | 592481 | 114 | 56 |
| 1012921 | 1012940 | hotspot | GTAGTTGTCTTCAGACAAAT | 592482 | 215 | 57 |
| 1013122 | 1013141 | hotspot | TGTTTACATCCCCAAATCTG | 592483 | 191 | 58 |
| 1013292 | 1013311 | hotspot | GTGTAATGTGTGGCTGACTT | 592484 | 153 | 59 |
| 1013488 | 1013507 | hotspot | GTGTATATGCTAGCTTGTGC | 592485 | 132 | 60 |
| 1013658 | 1013677 | hotspot | TACCCATTCCTTGATCAATT | 592486 | 138 | 61 |
| 1013857 | 1013876 | hotspot | TGTAGATAAAGAAATTATCT | 592487 | 0 | 62 |
| 1014197 | 1014216 | hotspot | AGCCAACATTGTTTAACCAG | 592488 | 180 | 63 |
| 1014367 | 1014386 | hotspot | TTGCCAGGCTTGTGCCAGAT | 592489 | 196 | 64 |
| 1014538 | 1014557 | hotspot | AATAATATCTACTTGTGTCC | 592490 | 80 | 65 |
| 1014708 | 1014727 | hotspot | ATCCAATTTCTAGTTGAATC | 592491 | 141 | 66 |
| 1014878 | 1014897 | hotspot | TACTTAAGTGATGTCACTGA | 592492 | 132 | 67 |
| 1015048 | 1015067 | hotspot | TAATCTTGTGATATGGTATG | 592493 | 101 | 68 |
| 1015218 | 1015237 | hotspot | GAGTGAAAATCAGTCTAACT | 592494 | 76 | 69 |
| 1015546 | 1015565 | hotspot | GAGATTTTAGGATGTGTTTC | 592495 | 40 | 70 |
| 1015716 | 1015735 | hotspot | ACACTACTTTAGAGTGCACA | 592496 | 181 | 71 |
| 1015911 | 1015930 | hotspot | ATTCTTTAAAATGTGAACTG | 592497 | 28 | 72 |
| 1016081 | 1016100 | hotspot | ATATCATCAAGGAAAATGTT | 592498 | 14 | 73 |
| 1016262 | 1016281 | hotspot | ATTAAATCCTAGGTTTGCTC | 592499 | 68 | 74 |
| 1016432 | 1016451 | hotspot | CTGCCAACCAAGAATTACTA | 592500 | 158 | 75 |
| 1016602 | 1016621 | hotspot | AAGACATGGCTACAGACAAC | 592501 | 177 | 76 |
| 1016772 | 1016791 | hotspot | GAGGAAACAGTTGTTATGAC | 592502 | 53 | 77 |

TABLE 1-continued

| Target Start Site | Target Stop Site | Region | Sequence | ISIS No | % upregulation | SEQ ID NO |
|---|---|---|---|---|---|---|
| 1017123 | 1017142 | hotspot | CAGCACCCAAGGAGCTGAAG | 592504 | 52 | 78 |
| 1017650 | 1017669 | hotspot | TTTAAGAGGCTGAAGAATTA | 592507 | 42 | 79 |

TABLE 2

| Target Start Site | Target Stop Site | Region | Sequence | ISIS No | % upregulation | SEQ ID NO |
|---|---|---|---|---|---|---|
| 1017820 | 1017839 | hotspot | GGAAGTTTGTGGCATTGGTG | 592508 | 95 | 80 |
| 1018002 | 1018021 | hotspot | TGATTGAGGATTCAAAACAA | 592509 | 65 | 81 |
| 1018172 | 1018191 | hotspot | TTATTACAAGGGTCAAAAGA | 592510 | 38 | 82 |
| 1018342 | 1018361 | hotspot | GTGCTAGCCAGTGTAGAGTT | 592511 | 115 | 83 |
| 1018516 | 1018535 | hotspot | TGCCAGATGGAATTGGTCTG | 592512 | 66 | 84 |
| 1018687 | 1018706 | hotspot | CTAGTGAATGAATTGGATAA | 592513 | 42 | 85 |
| 1019053 | 1019072 | hotspot | CAAACAAAAGCTTTCCACAT | 592515 | 159 | 86 |
| 1019228 | 1019247 | hotspot | CAAAGATGAAATATATTGGT | 592516 | 44 | 87 |
| 1019398 | 1019417 | hotspot | CGAGTCCAACAATGAACCAA | 592517 | 191 | 88 |
| 1019568 | 1019587 | hotspot | CTCAATCTTCACAAAATGTT | 592518 | 105 | 89 |
| 1019738 | 1019757 | hotspot | ATTAAAATTAAACTGATCTC | 592519 | 11 | 90 |
| 1019929 | 1019948 | hotspot | GTAGACAATAGTTCGAATAA | 592520 | 52 | 91 |
| 1020102 | 1020121 | hotspot | ACCCTACCTCAACAAAGAGC | 592521 | 78 | 92 |
| 1020285 | 1020304 | hotspot | AACAAGGAATATTATGTGGG | 592522 | 61 | 93 |
| 1020480 | 1020499 | hotspot | TTTACATATACGAGCAATAA | 592523 | 15 | 94 |
| 1020650 | 1020669 | hotspot | ACGAGCCAAAATGTGACATT | 592524 | 60 | 95 |
| 1020820 | 1020839 | hotspot | TGTTGGAACTTGAATTACTA | 592525 | 123 | 96 |
| 1021024 | 1021043 | hotspot | GTGATCCTAAGTACTGAATC | 592526 | 27 | 97 |
| 1021212 | 1021231 | hotspot | GAAGCCTCTTGCAATTAATC | 592527 | 151 | 98 |
| 1021382 | 1021401 | hotspot | AAGGAACAATTTCGACTCAG | 592528 | 184 | 99 |
| 1021567 | 1021586 | hotspot | TTTTGAGAAATCACTACTAC | 592529 | 68 | 100 |
| 1021749 | 1021768 | hotspot | AATGATTGGATAGCTTGTTT | 592530 | 44 | 101 |
| 1021930 | 1021949 | hotspot | CTGGAAAAAGTGCAATTTTT | 592531 | 58 | 102 |
| 1022276 | 1022295 | hotspot | CAACAGTGAAATGACAATTT | 592532 | 28 | 103 |
| 1022446 | 1022465 | hotspot | GGAAGAATCTAGAACCTTTC | 592533 | 94 | 104 |
| 1022791 | 1022810 | hotspot | TGCTCAATTTAAATAAAAGC | 592535 | 22 | 105 |
| 1022961 | 1022980 | hotspot | GAGACAGTGATTCTCATACA | 592536 | 52 | 106 |
| 1023136 | 1023155 | hotspot | TGTGGCTTTAGAATAAGCTG | 592537 | 54 | 107 |
| 1023311 | 1023330 | hotspot | GCATGTGTAAATCAAAGCTC | 592538 | 66 | 108 |
| 1023510 | 1023529 | hotspot | ACACTGGTACTATAATTTTT | 592539 | 61 | 109 |
| 1023851 | 1023870 | hotspot | GTCTTTTAACTATTAATAAA | 592540 | 19 | 110 |
| 1024021 | 1024040 | hotspot | CCCCGAAAATTTCTGCCACT | 592541 | 135 | 111 |

TABLE 2-continued

| Target Start Site | Target Stop Site | Region | Sequence | ISIS No | % upregulation | SEQ ID NO |
|---|---|---|---|---|---|---|
| 1024192 | 1024211 | hotspot | ACTATGTGTGTGCACGCACG | 592542 | 24 | 112 |
| 1024989 | 1025008 | hotspot | GGTATGAACTCAGTTTTCTT | 592543 | 110 | 113 |
| 1025159 | 1025178 | hotspot | TGTTTCTACATAACCAACTC | 592544 | 100 | 114 |
| 1025339 | 1025358 | hotspot | AAATCCATCATGTTTTTATA | 592545 | 32 | 115 |
| 1025509 | 1025528 | hotspot | GTGTATGAAGACTCATCCTG | 592546 | 114 | 116 |
| 1025708 | 1025727 | hotspot | GGAGTGGTTTCAACTTTTCT | 592547 | 133 | 117 |
| 1025898 | 1025917 | hotspot | GTTTCCAAAACTCTTGCATC | 592548 | 120 | 118 |
| 1026088 | 1026107 | hotspot | TGAGCTACATCCCTATCCCC | 592549 | 118 | 119 |
| 1026258 | 1026277 | hotspot | ATAATTGAAATATTAACTCT | 592550 | 3 | 120 |
| 1026437 | 1026456 | hotspot | ACCATACAATGAGCAGACTG | 592551 | 108 | 121 |
| 1026607 | 1026626 | hotspot | AATTACTATCCTTTGAGAGG | 592552 | 22 | 122 |
| 1026777 | 1026796 | hotspot | TAAGTCACATTCTTTGTGTA | 592553 | 29 | 123 |
| 1026947 | 1026966 | hotspot | GATTGTTGCTATAGTTGCAG | 592554 | 62 | 124 |
| 1027117 | 1027136 | hotspot | TTGGGTTGAGATAAGTAGCT | 592555 | 84 | 125 |
| 1027287 | 1027306 | hotspot | GTTTAAAATGAACGACTTGT | 592556 | 93 | 126 |
| 1027459 | 1027478 | hotspot | TAGGAGGACCTGAGCAGGAG | 592557 | 75 | 127 |
| 1027629 | 1027648 | hotspot | CCAAGAAGGTAAATTCTGAA | 592558 | 88 | 128 |
| 1027799 | 1027818 | hotspot | GCCATACATATATCATTATT | 592559 | 118 | 129 |
| 1027971 | 1027990 | hotspot | TTGAAATAATATACTTTGAA | 592560 | 3 | 130 |
| 1028485 | 1028504 | hotspot | ATTGAAGTGGCAAGAGTGTA | 592563 | 51 | 131 |
| 1028655 | 1028674 | hotspot | TGTATTAACCTTATATACTG | 592564 | 36 | 132 |
| 1029011 | 1029030 | hotspot | CATCAAGATAATTTTACCTG | 592566 | 23 | 133 |
| 1029188 | 1029207 | hotspot | CTATCTTTGTCAAAAACACG | 592567 | 70 | 134 |
| 1029389 | 1029408 | hotspot | AACACTTTGTGTACATGTTT | 592568 | 40 | 135 |
| 1029559 | 1029578 | hotspot | TCCACAAAGCAATGAGTTCA | 592569 | 85 | 136 |
| 1029736 | 1029755 | hotspot | TCCAGAGCATTTCATCGCTG | 592570 | 133 | 137 |
| 1029908 | 1029927 | hotspot | AAGACTTATTTTCTAAAACC | 592571 | 6 | 138 |
| 1030078 | 1030097 | hotspot | TCCCTTGACTTGGATTATAC | 592572 | 93 | 139 |
| 1030248 | 1030267 | hotspot | AAATTAAGATTATTATGCTG | 592573 | 7 | 140 |
| 1030418 | 1030437 | hotspot | CCTTCATTTTCACAAAGCCA | 592574 | 150 | 141 |
| 1030607 | 1030626 | hotspot | GCAACTGATACCTTAATTCG | 592575 | 93 | 142 |
| 1030777 | 1030796 | hotspot | GAATAGAGTTTCTGGAATCA | 592576 | 102 | 143 |
| 1030986 | 1031005 | hotspot | AGGAGGCCTTCAGAAGTGCG | 592577 | 101 | 144 |
| 1031156 | 1031175 | hotspot | AAAATTCCTTTTTAGATTAA | 592578 | 17 | 145 |
| 1031326 | 1031345 | hotspot | ATTTACTCAGGTTATCTTCC | 592579 | 81 | 146 |
| 1031505 | 1031524 | hotspot | TCCACATAAACATGGAAGGA | 592580 | 26 | 147 |
| 1031845 | 1031864 | hotspot | ATCCCAACTCATAGACACCT | 592582 | 134 | 148 |
| 1032185 | 1032204 | hotspot | TAGTAACTTCCATTTGCTGC | 592583 | 118 | 149 |
| 1032355 | 1032374 | hotspot | AATCAACCTCTTTTAAAGAA | 592584 | 9 | 150 |

TABLE 2-continued

| Target Start Site | Target Stop Site | Region | Sequence | ISIS No | % upregulation | SEQ ID NO |
|---|---|---|---|---|---|---|
| 1032525 | 1032544 | hotspot | AATTCATTTGCAATAACCTT | 592585 | 41 | 151 |
| 1032695 | 1032714 | hotspot | GATTGTCATGGAACAATACT | 592586 | 64 | 152 |
| 1032873 | 1032892 | hotspot | TTCAAATGATAATATAGATT | 592587 | 10 | 153 |

TABLE 3

| Target Start Site | Target Stop Site | Region | Sequence | ISIS No | % upregulation | SEQ ID NO |
|---|---|---|---|---|---|---|
| 997638 | 997657 | hotspot | GAAATTCCCAAGAGTAGAAT | 592398 | 0 | 154 |
| 997810 | 997829 | hotspot | GGCTCAGAATTGAAACCAAA | 592399 | 142 | 155 |
| 997998 | 998017 | hotspot | ATACTAAAAATGTCATCTTC | 592400 | 19 | 156 |
| 998168 | 998187 | hotspot | CCAGCCTTGTTGGATATCAT | 592401 | 147 | 157 |
| 998338 | 998357 | hotspot | TGAGGTTCAGTAAGAGCCCC | 592402 | 178 | 158 |
| 998518 | 998537 | hotspot | GATCCATTTGTGTTAAGCTG | 592403 | 111 | 159 |
| 998688 | 998707 | hotspot | AGGTATTTCGAGTGTGATTA | 592404 | 224 | 160 |
| 998870 | 998889 | hotspot | TACCATAGAGAAACCTAATT | 592405 | 83 | 161 |
| 999040 | 999059 | hotspot | TGGGACTTAATGACCTTGGA | 592406 | 151 | 162 |
| 999213 | 999232 | hotspot | GTCCCAGAAAAGAATCTCTC | 592407 | 145 | 163 |
| 999393 | 999412 | hotspot | TCAGTCCAGCTCTTTAGTTC | 592408 | 199 | 164 |
| 999733 | 999752 | hotspot | TTGGATCCTTAAAATTTTAG | 592409 | 30 | 165 |
| 999903 | 999922 | hotspot | GAATTTATTATTGCATGGTG | 592410 | 122 | 166 |
| 1000100 | 1000119 | hotspot | GCATGAAATTGTCAAAGAAC | 592411 | 104 | 167 |
| 1000270 | 1000289 | hotspot | AATGGATAATTCTGAAGTCT | 592412 | 46 | 168 |
| 1000440 | 1000459 | hotspot | AGCTCATAGTACCAGTGGCT | 592413 | 145 | 169 |
| 1000626 | 1000645 | hotspot | CATGGTCATGAAAACAAGTA | 592414 | 100 | 170 |
| 1000796 | 1000815 | hotspot | TAGTGACATAGTTTTATGGT | 592415 | 62 | 171 |
| 1000971 | 1000990 | hotspot | GTATACCATTCATATTTCTA | 592416 | 188 | 172 |
| 1001141 | 1001160 | hotspot | AAGAAACACTGAGAGCCTGA | 592417 | 142 | 173 |
| 1001313 | 1001332 | hotspot | ATTAGGCTTATTGATGTCTG | 592418 | 127 | 174 |
| 1001483 | 1001502 | hotspot | AATACAATATTATTGCCATG | 592419 | 36 | 175 |
| 1001830 | 1001849 | hotspot | GATTAGGTGTGCTTTCAGAC | 592421 | 157 | 176 |
| 1002002 | 1002021 | hotspot | CGGGTTAGAGGAAGAATTAT | 592422 | 15 | 177 |
| 1002172 | 1002191 | hotspot | TATAAGCCACAAACATCTTG | 592423 | 148 | 178 |
| 1002355 | 1002374 | hotspot | TCATTGTGACAGTAAAGAAA | 592424 | 106 | 179 |
| 1002525 | 1002544 | hotspot | TAACTGGGTTAATTTACTAC | 592425 | 49 | 180 |
| 1002695 | 1002714 | hotspot | TATGTAGGAACATTTTTAGT | 592426 | 43 | 181 |
| 1002894 | 1002913 | hotspot | ACCAGTTGATCATGTTTTAT | 592427 | 95 | 182 |
| 1033418 | 1033437 | antisense to Ube3a pre-mRNA | TACAAGCTACAGATAACCTG | 592348 | 32 | 183 |

TABLE 3-continued

| Target Start Site | Target Stop Site | Region | Sequence | ISIS No | % upregulation | SEQ ID NO |
|---|---|---|---|---|---|---|
| 1037625 | 1037644 | antisense to Ube3a pre-mRNA | TGAGAGACATTTGTCTCTGG | 592351 | 30 | 184 |
| 1039051 | 1039070 | antisense to Ube3a pre-mRNA | ATTTCTACATGGTCATTCCT | 592352 | 59 | 185 |
| 1046085 | 1046104 | antisense to Ube3a pre-mRNA | AGATGTCTATACTAAGAAAC | 592356 | 2 | 186 |
| 1047501 | 1047520 | antisense pre-mRNA antisense | CAACTTAATTGCTTTTTGAA | 592357 | 16 | 187 |
| 1050351 | 1050370 | antisense to Ube3a pre-mRNA | GATACATTATCATTGTTATA | 592358 | 10 | 188 |
| 1051751 | 1051770 | antisense to Ube3a pre-mRNA | TCTGGTTTTCTCAAGTTCAG | 592359 | 49 | 189 |
| 1053151 | 1053170 | antisense to Ube3a pre-mRNA | ACAGTTGATATGTGTGTGGC | 592360 | 39 | 190 |
| 1054551 | 1054570 | antisense to Ube3a pre-mRNA | GCTTAATTGTCCTTGAGACC | 592361 | 41 | 191 |
| 1055951 | 1055970 | antisense to Ube3a pre-mRNA | AGTGTCAGACCTACCTATTA | 592362 | 36 | 192 |
| 1057351 | 1057370 | antisense to Ube3a pre-mRNA | GGCGGGTTGTATTTTGAGAG | 592363 | 0 | 193 |
| 1058771 | 1058790 | antisense to Ube3a pre-mRNA | GCAACAAGAACTTGATTTAA | 592364 | 35 | 194 |
| 1060171 | 1060190 | antisense to Ube3a pre-mRNA | GTAGGCGAGTAAATTAGAAT | 592365 | 20 | 195 |
| 1062997 | 1063016 | antisense to Ube3a pre-mRNA | ACTAGAAACCGAACTTGGCG | 592366 | 31 | 196 |
| 1064397 | 1064416 | antisense to Ube3a pre-mRNA | GGAATACATAAGATGAGTCA | 592367 | 28 | 197 |
| 1065809 | 1065828 | antisense to Ube3a pre-mRNA | AAAAGTTTCTTTACTTAAC | 592368 | 0 | 198 |
| 1067235 | 1067254 | antisense to Ube3a pre-mRNA | AGGACTGGTATTTAGTTTGT | 592369 | 14 | 199 |
| 1068635 | 1068654 | antisense pre-mRNA antisense | CATGAAGTTTTAGAATGAAA | 592370 | 0 | 200 |
| 1070036 | 1070055 | antisense to Ube3a pre-mRNA | GCATATCCATTTTCAATAAA | 592371 | 11 | 201 |
| 1071436 | 1071455 | antisense to Ube3a pre-mRNA | AAAAGGCATATTTTTATTT | 592372 | 0 | 202 |

TABLE 3-continued

| Target Start Site | Target Stop Site | Region | Sequence | ISIS No | % upregulation | SEQ ID NO |
|---|---|---|---|---|---|---|
| 1072836 | 1072855 | antisense to Ube3a pre-mRNA | TACTTTCAGTCTTGTAATAC | 592373 | 20 | 203 |
| 1074250 | 1074269 | antisense to Ube3a pre-mRNA | GATTTCCAATATTCTTCATC | 592374 | 10 | 204 |
| 1075650 | 1075669 | antisense to Ube3a pre-mRNA | CCAAACAATTTTCAGATATA | 592375 | 1 | 205 |
| 1077065 | 1077084 | antisense to Ube3a pre-mRNA | GGTATTTTCCTCAATTACAT | 592376 | 23 | 206 |
| 1078467 | 1078486 | antisense to Ube3a pre-mRNA | GCCACCATATGGTTGCTGGG | 592377 | 147 | 207 |
| 1079867 | 1079886 | antisense to Ube3a pre-mRNA | CAGGCATAAGAGTCAGAAGC | 592378 | 24 | 208 |
| 1081267 | 1081286 | antisense to Ube3a pre-mRNA | TTGAGGAAGAGGGCTAATTT | 592379 | 2 | 209 |
| 1084067 | 1084086 | antisense to Ube3a pre-mRNA | GTTTTCCAGTGAGTACCAGC | 592380 | 4 | 210 |
| 1085491 | 1085510 | antisense to Ube3a pre-mRNA | TAACTAGAGGAATACCAACT | 592381 | 2 | 211 |
| 1086900 | 1086919 | antisense to Ube3a pre-mRNA | GAAAGCATCCTTAGTTTCTC | 592382 | 9 | 212 |
| 1088316 | 1088335 | antisense to Ube3a pre-mRNA | TTGCAGCATTAATTAAACAA | 592383 | 9 | 213 |
| 1091119 | 1091138 | antisense to Ube3a pre-mRNA | GGCAATTAAATTCTACTTTT | 592384 | 1 | 214 |
| 1093920 | 1093939 | antisense to Ube3a pre-mRNA | CTGGAGTTTGTGATGGTTGT | 592386 | 9 | 215 |
| 1095320 | 1095339 | antisense to Ube3a pre-mRNA | AGGATATATTTTGGCAACTT | 592387 | 0 | 216 |
| 1096720 | 1096739 | antisense to Ube3a pre-mRNA | TTTATCAGAAATGCCTGGGA | 592388 | 1 | 217 |
| 1099541 | 1099560 | antisense to Ube3a pre-mRNA | GTCCATCTATCAATTTATTA | 592389 | 22 | 218 |
| 1100945 | 1100964 | antisense to Ube3a pre-mRNA | TTTAAATAGCTGATTATCTG | 592390 | 4 | 219 |
| 1102346 | 1102365 | antisense to Ube3a pre-mRNA | CAAGAGATAATAGCTTAATT | 592391 | 6 | 220 |
| 1103750 | 1103769 | antisense to Ube3a pre-mRNA | ATTAGTTGATACCACTCTTC | 592392 | 23 | 221 |

TABLE 3-continued

| Target Start Site | Target Stop Site | Region | Sequence | ISIS No | % upregulation | SEQ ID NO |
|---|---|---|---|---|---|---|
| 1105150 | 1105169 | antisense to Ube3a pre-mRNA | AGTGAAACCAGAGTAGTAGT | 592393 | 3 | 222 |
| 1106554 | 1106573 | antisense to Ube3a pre-mRNA | CATGTGGTATATATAAAATG | 592394 | 0 | 223 |
| 1107954 | 1107973 | antisense to Ube3a pre-mRNA | AGCCTAGACTAAGAGGCGAG | 592395 | 0 | 224 |
| 1109354 | 1109373 | antisense to Ube3a pre-mRNA | GCTAAATATCAAAGCCCTAT | 592396 | 8 | 225 |

Example 2

Antisense Inhibition of the Antisense Sequence of Ubiquitin Protein Ligase E3A (Ube3a-ATS) in Primary Neuronal Cells Antisense oligonucleotides selected from the study described above were tested for their effects on inhibiting the expression of Ube3a-ATS mRNA in vitro.

Primary neuronal cultures from Ube3a-YFP paternal$^{+/-}$ mice were prepared, as described above. Cells were seeded on poly-D-lysine-coated 24-well plates at a density of 2.5× $10^5$ cells/cm$^2$ in 500 µL of culture medium. At day 4, 400 µL medium was removed from sets of wells and 100 µL of fresh medium, along with 10 µM antisense oligonucleotide and 2 µM Ara-C were added. A set of cells treated with PBS was used as the untreated control. At day 7, the sets were washed with PBS twice and RNA isolation was conducted.

Total RNA was prepared with miRNAeasy Mini Kit (Qiagen, Valencia, Calif.). On-column DNase treatment was performed for all the samples. mRNA was purified from total RNA with oligo(dT) beads supplied in Illumina mRNA-seq Sample Preparation Kit, according to the manufacturer's instructions (Illumina, San Diego, Calif.). cDNA was then generated with SuperScript III First-Strand Synthesis System (Invitrogen) and q-PCR was performed using Applied Biosystems StepOnePlus Real-Time PCR System and SYBR Green Master Mix (Applied Biosystems, Carlsbad, Calif.).

The results are presented in Table 4, expressed as a percentage of the untreated control. The data indicates that treatment with antisense oligonucleotides targeted to the hotspot region that we identified results in marked inhibition of the Ube3a-YFP-ATS mRNA transcript and correspondingly induces expression of the paternal Ube3a-YFP transcript.

TABLE 4

% expression of mRNA transcript expression relative to the untreated control

|  | % inhibition of Ube3a-YFP-ATS | % induction of Ube3a-YFP |
|---|---|---|
| ISIS 592467 | 88 ± 2 | 71 ± 23 |
| ISIS 592517 | 94 ± 5 | 128 ± 5 |
| ISIS 592528 | 81 ± 9 | 288 ± 71 |
| ISIS 592404 | 94 ± 4 | 137 ± 12 |

Example 3

Dose-Dependent Antisense Inhibition of Ube3a-ATS and Up-Regulation of Paternal Ube3a in Primary Neuronal Cells Antisense oligonucleotides selected from the study described above were tested for their effects on inhibiting the expression of Ube3a-ATS mRNA and up-regulating the expression of paternal Ube3a in vitro. The effect on snoRNA genes near the hotspot region and some of which have been shown to be involved in Prader-Willi syndrome (Sahoo, T. et al., Nat. Genet. 2008. 40: 719-21; Tsai, T. et al., Hum. Mol. Genet. 1999. 8: 1357-64) was also assessed.

Primary neuronal cultures from Ube3a-YFP paternal$^{+/-}$ mice were prepared, as described above, and transfected with 39 nM, 156 nM, 625 nM, 2,500 nM, or 10,000 nM concentrations of antisense oligonucleotide. The cells were separately treated with the topoisomerase inhibitor, Topotecan, at 1.17 nM, 4.69 nM, 18.75 nM, 75.00 nM, or 300.00 nM concentrations. Total RNA was prepared with RNeasy 96 Kit (Qiagen). On-column DNase treatment was performed for all the samples. qRT-PCR was performed using EXPRESS One-Step SuperScript qRT-PCR Kit (Qiagen) and EXPRESS One-Step SYBR GreenER Kit (Qiagen).

The results are presented in Tables 5 and 6, expressed as a percentage of the untreated control. The data indicates that treatment with antisense oligonucleotides targeted to the hotspot region that we identified resulted in marked inhibition of the Ube3a-YFP-ATS transcript and correspondingly induced expression of the paternal Ube3a-YFP transcript. Treatment with Topotecan also inhibited Ube3a-YFP-ATS transcript levels and induced the expression of Ube3a-YFP mRNA as expected. Several of ISIS antisense oligonucleotides inhibited Ube3a-YFP-ATS and up-regulated Ube3a-YFP mRNA levels.

The cells were also assessed for the induction of Ube3a-YFP protein, as quantified by fluorescence, using the method described in Example 1. The results are presented in Table 7, and demonstrate that treatment with antisense oligonucleotides targeted to the hotspot region that we identified resulted in an increase in Ube3a-YFP protein levels, as indicated by increased YFP fluorescence. Treatment with Topotecan also induced the expression of Ube3a-YFP protein levels, as expected. The expression levels of the MBII-85 and MBII-52 snoRNAs and Snrpn were also evaluated. The results are presented in Tables 8-10. The data indicates that treatment with antisense oligonucleotides targeted to the hotspot region resulted in minimal reduction in these snoRNA genes, the reduction of which is associated with Prader-Willi syndrome. By contrast, treatment with Topotecan reduced the levels of the snoRNA gene MBII-52, and Snrpn levels.

TABLE 5

% inhibition of Ube3a-YFP-ATS transcript expression relative to the untreated control

| ISIS No | 39 nM | 156 nM | 625 nM | 2,500 nM | 10,000 nM |
|---|---|---|---|---|---|
| 592401 | 0 | 0 | 40 | 68 | 91 |
| 592404 | 32 | 50 | 78 | 93 | 96 |
| 592408 | 29 | 40 | 49 | 67 | 75 |
| 592413 | 34 | 43 | 63 | 75 | 85 |
| 592482 | 0 | 16 | 55 | 86 | 94 |
| 592483 | 19 | 49 | 62 | 91 | 96 |
| 592489 | 0 | 33 | 62 | 85 | 93 |
| 592515 | 6 | 37 | 69 | 87 | 91 |
| 592517 | 12 | 66 | 71 | 89 | 96 |
| 592528 | 0 | 59 | 77 | 92 | 93 |
| Small molecule inhibitor | 1.17 nM | 4.69 nM | 18.75 nM | 75.00 nM | 300.00 nM |
| Topotecan | 23 | 33 | 50 | 73 | 88 |

TABLE 6

% Ube3a-YFP transcript expression relative to the untreated control

| ISIS No | 39 nM | 156 nM | 625 nM | 2,500 nM | 10,000 nM |
|---|---|---|---|---|---|
| 592401 | 103 | 183 | 305 | 753 | 955 |
| 592404 | 151 | 260 | 499 | 890 | 810 |
| 592408 | 89 | 97 | 189 | 240 | 616 |
| 592413 | 136 | 145 | 254 | 556 | 764 |
| 592482 | 142 | 167 | 372 | 697 | 1277 |
| 592483 | 150 | 163 | 237 | 607 | 852 |
| 592489 | 149 | 188 | 215 | 514 | 646 |
| 592515 | 145 | 136 | 192 | 467 | 705 |
| 592517 | 151 | 189 | 237 | 528 | 821 |
| 592528 | 215 | 268 | 378 | 715 | 639 |
| Small molecule inhibitor | 1.17 nM | 4.69 nM | 18.75 nM | 75.00 nM | 300.00 nM |
| Topotecan | 124 | 127 | 193 | 430 | 734 |

TABLE 7

% Ube3a-YFP protein expression relative to the untreated control

| ISIS No | 39 nM | 156 nM | 625 nM | 2,500 nM | 10,000 nM |
|---|---|---|---|---|---|
| 592401 | 95 | 102 | 109 | 154 | 193 |
| 592404 | 95 | 108 | 153 | 183 | 262 |
| 592408 | 100 | 96 | 105 | 134 | 173 |
| 592413 | 107 | 104 | 109 | 126 | 185 |
| 592482 | 95 | 110 | 130 | 135 | 201 |
| 592483 | 94 | 109 | 97 | 148 | 202 |
| 592489 | 102 | 105 | 104 | 132 | 177 |
| 592515 | 101 | 112 | 104 | 134 | 177 |
| 592517 | 97 | 104 | 121 | 137 | 211 |
| 592528 | 102 | 121 | 117 | 146 | 207 |
| Small molecule inhibitor | 1.17 nM | 4.69 nM | 18.75 nM | 75.00 nM | 300.00 nM |
| Topotecan | 102 | 112 | 139 | 217 | 290 |

TABLE 8

% MBII-85 transcript expression relative to the untreated control

| ISIS No | 39 nM | 156 nM | 625 nM | 2,500 nM | 10,000 nM |
|---|---|---|---|---|---|
| 592401 | 96 | 114 | 118 | 122 | 125 |
| 592404 | 108 | 79 | 87 | 101 | 93 |
| 592408 | 83 | 66 | 81 | 75 | 81 |
| 592413 | 74 | 72 | 68 | 79 | 85 |
| 592482 | 121 | 91 | 81 | 106 | 88 |
| 592483 | 84 | 84 | 91 | 97 | 102 |
| 592489 | 74 | 78 | 100 | 94 | 69 |
| 592515 | 66 | 108 | 93 | 88 | 118 |
| 592517 | 54 | 73 | 94 | 74 | 98 |
| 592528 | 81 | 98 | 119 | 139 | 115 |
| Small molecule inhibitor | 1.17 nM | 4.69 nM | 18.75 nM | 75.00 nM | 300.00 nM |
| Topotecan | 93 | 84 | 79 | 67 | 85 |

TABLE 9

% MBII-52 transcript expression relative to the untreated control

| ISIS No | 39 nM | 156 nM | 625 nM | 2,500 nM | 10,000 nM |
|---|---|---|---|---|---|
| 592401 | 98 | 138 | 106 | 112 | 86 |
| 592404 | 91 | 66 | 73 | 63 | 31 |
| 592408 | 94 | 62 | 97 | 89 | 75 |
| 592413 | 80 | 83 | 92 | 104 | 82 |
| 592482 | 107 | 94 | 87 | 95 | 63 |
| 592483 | 104 | 102 | 103 | 100 | 97 |
| 592489 | 106 | 98 | 101 | 99 | 87 |
| 592515 | 100 | 103 | 104 | 104 | 120 |
| 592517 | 109 | 95 | 106 | 95 | 92 |
| 592528 | 106 | 119 | 143 | 131 | 111 |
| Small molecule inhibitor | 1.17 nM | 4.69 nM | 18.75 nM | 75.00 nM | 300.00 nM |
| Topotecan | 112 | 92 | 81 | 50 | 40 |

TABLE 10

% Snrpn transcript expression relative to the untreated control

| ISIS No | 39 nM | 156 nM | 625 nM | 2,500 nM | 10,000 nM |
|---|---|---|---|---|---|
| 592401 | 93 | 127 | 107 | 133 | 114 |
| 592404 | 76 | 88 | 99 | 102 | 92 |
| 592408 | 75 | 81 | 94 | 80 | 85 |
| 592413 | 83 | 74 | 78 | 88 | 78 |
| 592482 | 126 | 105 | 105 | 74 | 46 |
| 592483 | 115 | 115 | 99 | 108 | 103 |
| 592489 | 125 | 12 | 98 | 87 | 72 |
| 592515 | 101 | 114 | 101 | 95 | 103 |

TABLE 10-continued

% Snrpn transcript expression relative to the untreated control

| ISIS No | 39 nM | 156 nM | 625 nM | 2,500 nM | 10,000 nM |
|---|---|---|---|---|---|
| 592517 | 99 | 109 | 99 | 71 | 45 |
| 592528 | 122 | 108 | 109 | 114 | 111 |
| Small molecule inhibitor | 1.17 nM | 4.69 nM | 18.75 nM | 75.00 nM | 300.00 nM |
| Topotecan | 102 | 99 | 87 | 71 | 54 |

Example 4

Comparison of the Effect of ASOs Targeting the Hotspot Region and ASOs Targeting within the Region Antisense to the Ube3a Pre-mRNA on the Up-Regulation of Paternal Ube3a Transcript in Primary Neuronal Cells To evaluate the optimal region for targeting with antisense oligonucleotides resulting in up-regulation of paternal Ube3a gene transcript, treatment with ASOs targeting the hotspot region and treatment with ASOs targeting within the region antisense to the Ube3a pre-mRNA was assessed.

Primary neuronal cultures from Ube3a-YFP paternal$^{+/-}$ mice were prepared, as described above, and transfected with 15 μM concentration of antisense oligonucleotide. Total RNA was prepared with RNeasy 96 Kit (Qiagen). On-column DNase treatment was performed for all the samples. qRT-PCR was performed using EXPRESS One-Step SuperScript qRT-PCR Kit (Qiagen) and EXPRESS One-Step SYBR GreenER Kit (Qiagen). The results are presented in Table 10, expressed as a percentage of the untreated control.

The data indicates that treatment with antisense oligonucleotides targeting both regions resulted in marked inhibition of the Ube3a-YFP-ATS mRNA transcript. However, treatment with ASOs targeting the hotspot region resulted in markedly higher upregulation of paternal Ube3a-YFP transcript expression compared to treatment with ASOs targeting the region antisense to the Ube3a pre-mRNA.

TABLE 11

% expression levels compared to the untreated control

| Target Start Site | Target Stop Site | Region | ISIS No | % expression of Ube3a-YFP-ATS | % expression of Ube3Pa-YFP | SEQ ID NO |
|---|---|---|---|---|---|---|
| 997810 | 997829 | hotspot | 592399 | 4 | 624 | 155 |
| 997998 | 998017 | hotspot | 592400 | 7 | 259 | 156 |
| 998168 | 998187 | hotspot | 592401 | 3 | 936 | 157 |
| 998688 | 998707 | hotspot | 592404 | 7 | 1139 | 160 |
| 998870 | 998889 | hotspot | 592405 | 9 | 518 | 161 |
| 999040 | 999059 | hotspot | 592406 | 7 | 644 | 162 |
| 999213 | 999232 | hotspot | 592407 | 10 | 555 | 163 |
| 999393 | 999412 | hotspot | 592408 | 6 | 670 | 164 |
| 1000270 | 1000289 | hotspot | 592412 | 14 | 827 | 168 |
| 1000440 | 1000459 | hotspot | 592413 | 16 | 576 | 169 |
| 1000971 | 1000990 | hotspot | 592416 | 10 | 802 | 172 |
| 1001141 | 1001160 | hotspot | 592417 | 15 | 935 | 173 |
| 1001830 | 1001849 | hotspot | 592421 | 12 | 1042 | 176 |
| 1002172 | 1002191 | hotspot | 592423 | 13 | 624 | 178 |
| 1002355 | 1002374 | hotspot | 592424 | 20 | 871 | 179 |
| 1033418 | 1033437 | hotspot | 592348 | 9 | 704 | 183 |
| 1046085 | 1046104 | antisense to Ube3a pre-mRNA | 592356 | 15 | 288 | 186 |
| 1057351 | 1057370 | antisense to Ube3a pre-mRNA | 592363 | 9 | 158 | 193 |
| 1058771 | 1058790 | antisense to Ube3a pre-mRNA | 592364 | 16 | 315 | 194 |
| 1062997 | 1063016 | antisense to Ube3a pre-mRNA | 592366 | 18 | 163 | 196 |
| 1072836 | 1072855 | antisense to Ube3a pre-mRNA | 592373 | 20 | 131 | 203 |
| 1078467 | 1078486 | antisense to Ube3a pre-mRNA | 592377 | 7 | 435 | 207 |
| 1085491 | 1085510 | antisense to Ube3a pre-mRNA | 592381 | 16 | 158 | 211 |
| 1086900 | 1086919 | antisense to Ube3a pre-mRNA | 592382 | 16 | 94 | 212 |
| 1099541 | 1099560 | antisense to Ube3a pre-mRNA | 592389 | 12 | 296 | 218 |
| 1100945 | 1100964 | antisense to Ube3a pre-mRNA | 592390 | 13 | 111 | 219 |
| 1102346 | 1102365 | antisense to Ube3a pre-mRNA | 592391 | 15 | 88 | 220 |
| 1103750 | 1103769 | antisense to Ube3a pre-mRNA | 592392 | 4 | 100 | 221 |
| 1109354 | 1109373 | antisense to Ube3a pre-mRNA | 592396 | 18 | 182 | 225 |

Example 5

Antisense Inhibition of the Antisense Sequence of Ube3a-ATS In Vivo

Antisense oligonucleotides, selected from the in vitro screening study described above, were screened for in vivo efficacy in wild-type C57BL6 mice.

Antisense oligonucleotide administration was accomplished by intracerebroventricular bolus injection of 300 μg in the mice. The mice were euthanized 4 weeks after the administration and the level of Ube3a-ATS mRNA down-regulation was assessed using sections from the cortex, hippocampus, and spinal cord. RNA isolation and qRT-PCR was performed as described in Example 4. The expression of MBII-85, MBII-52, and Snrpn were also evaluated.

The data is presented in Tables 12-15, normalized to the house-keeping gene, GAPDH. The results indicate that treatment with antisense oligonucleotides targeted to the hotspot region that we identified resulted in inhibition of the Ube3a-ATS mRNA transcript. Moreover, MBII-85, MBII-52, and Snrpn expression was maintained following knockdown of Ube3a-ATS.

TABLE 12

% expression of Ube3a-ATS transcript
expression relative to the untreated control

| ISIS No | Cortex | Hippocampus | Spinal Cord |
|---|---|---|---|
| 592401 | 35 | 44 | 48 |
| 592408 | 50 | 43 | 45 |
| 592413 | 38 | 45 | 67 |
| 592482 | 30 | 31 | 32 |
| 592489 | 28 | 36 | 52 |
| 592515 | 67 | 66 | 79 |
| 592517 | 39 | 43 | 44 |

TABLE 13

% expression of MBII-85 transcript
expression relative to the untreated control

| ISIS No | Cortex | Hippocampus | Spinal Cord |
|---|---|---|---|
| 592401 | 82 | 104 | 98 |
| 592408 | 99 | 96 | 112 |
| 592413 | 121 | 99 | 90 |
| 592482 | 85 | 74 | 99 |
| 592489 | 98 | 105 | 99 |
| 592515 | 101 | 100 | 92 |
| 592517 | 78 | 82 | 94 |

TABLE 14

% expression of MBII-52 transcript
expression relative to the untreated control

| ISIS No | Cortex | Hippocampus | Spinal Cord |
|---|---|---|---|
| 592401 | 90 | 103 | 92 |
| 592408 | 95 | 85 | 115 |
| 592413 | 103 | 103 | 91 |
| 592482 | 81 | 91 | 103 |
| 592489 | 135 | 118 | 124 |
| 592515 | 112 | 140 | 97 |
| 592517 | 92 | 103 | 98 |

TABLE 15

% expression of Snrpn transcript
expression relative to the untreated control

| ISIS No | Cortex | Hippocampus | Spinal Cord |
|---|---|---|---|
| 592401 | 92 | 90 | 92 |
| 592408 | 96 | 90 | 84 |
| 592413 | 97 | 97 | 80 |
| 592482 | 85 | 74 | 46 |
| 592489 | 96 | 88 | 74 |
| 592515 | 95 | 93 | 82 |
| 592517 | 88 | 87 | 49 |

Example 6

Antisense Inhibition of Ube3a-ATS in Ube3a-YFP Mice

Antisense oligonucleotides selected from the studies described above were screened for in vivo efficacy and tolerability in the Ube3a-YFP mouse model (Dindot, S. V. et al., Hum. Mol. Genet. 2008. 17: 111-118).

Antisense oligonucleotide was administered to the mice by intracerebroventricular bolus injection of 300 µg of ISIS 592401 or ISIS 592489. The mice were euthanized after 4 weeks of administration. Levels of Ube3a-YFP-ATS mRNA and Ube3a-YFP mRNA were assessed in the cortex, hippocampus and spinal cord. The assays were performed as described previously (Meng, L. et al., Hum. Mol. Genet. 2012. doi:10.1093/hmg/dds1).

RNA was isolated from the different brain sections and analyzed by qRT-PCR. The results are presented in Tables 16 and 17, normalized to GAPDH. The data indicates that ASO administration resulted in approximately 50-65% knockdown of Ube3a-YFP-ATS transcript in the brain and spinal cord. Correspondingly, there was an approximate 1.5-2-fold increase of Ube3a-YFP mRNA in ASO-treated mice. As shown in FIG. 1, Western Blot analysis was performed using an anti-YFP antibody and confirmed that treatment with ASO increased paternal Ube3a protein expression.

The expression of MBII-85, MBII-52, and Snrpn were also evaluated. As presented in Tables 18-20, MBII-85, MBII-52, and Snrpn expression was maintained following knockdown of Ube3a-YFP-ATS. Levels of the microglial marker AIF1 were also assessed as a measure of CNS toxicity. As presented in Table 21, there was negligible increase in Aif1 levels, indicating that ASO treatment was neurotolerable.

TABLE 16

% inhibition of Ube3a-YFP-ATS mRNA transcript
expression relative to untreated control

| | Cortex | Hippocampus | Spinal cord |
|---|---|---|---|
| ISIS 592401 | 48 ± 9 | 59 ± 9 | 63 ± 12 |
| ISIS 592489 | 59 ± 16 | 65 ± 5 | 64 ± 7 |

TABLE 17

% Ube3a-YFP mRNA transcript expression
relative to untreated control (denoted as 100%)

| | Cortex | Hippocampus | Spinal cord |
|---|---|---|---|
| ISIS 592401 | 169 ± 7 | 198 ± 22 | 176 ± 72 |
| ISIS 592489 | 140 ± 31 | 156 ± 22 | 142 ± 22 |

TABLE 18

% MBII-85 mRNA transcript expression
relative to untreated control (denoted as 100%)

| | Cortex | Hippocampus | Spinal cord |
|---|---|---|---|
| ISIS 592401 | 107 ± 13 | 114 ± 3 | 108 ± 11 |
| ISIS 592489 | 73 ± 25 | 102 ± 5 | 109 ± 16 |

TABLE 19

% MBII-52 mRNA transcript expression
relative to untreated control (denoted as 100%)

| | Cortex | Hippocampus | Spinal cord |
|---|---|---|---|
| ISIS 592401 | 75 ± 1 | 99 ± 0 | 83 ± 13 |
| ISIS 592489 | 95 ± 33 | 109 ± 9 | 91 ± 13 |

TABLE 20

% Snrpn mRNA transcript expression
relative to untreated control (denoted as 100%)

| | Cortex | Hippocampus | Spinal cord |
|---|---|---|---|
| ISIS 592401 | 103 ± 3 | 95 ± 4 | 91 ± 7 |
| ISIS 592489 | 94 ± 12 | 90 ± 6 | 92 ± 5 |

TABLE 21

% Aif1 mRNA transcript expression
relative to untreated control (denoted as 100%)

| | Cortex | Hippocampus | Spinal cord |
|---|---|---|---|
| ISIS 592401 | 94 ± 4 | 106 ± 7 | 111 ± 5 |
| ISIS 592489 | 92 ± 11 | 112 ± 21 | 182 ± 30 |

Example 7

Antisense Inhibition of Ube3a-ATS in Ube3a-YFP Mice

Antisense oligonucleotides selected from the studies described above were screened for in vivo efficacy and tolerability in the Ube3a-YFP mouse model (Dindot, S. V. et al., Hum. Mol. Genet. 2008. 17: 111-118).

Antisense oligonucleotide was administered to the mice by intracerebroventricular bolus injection of 500 µg of ISIS 592401. The mice were euthanized after 4 weeks of administration. Levels of Ube3a-YFP-ATS mRNA, Ube3a-YFP mRNA and Ube3a protein were assessed in the cortex, hippocampus and spinal cord. The assays were performed as described previously (Meng, L. et al., Hum. Mol. Genet. 2012. doi:10.1093/hmg/dds1).

Figure 2:
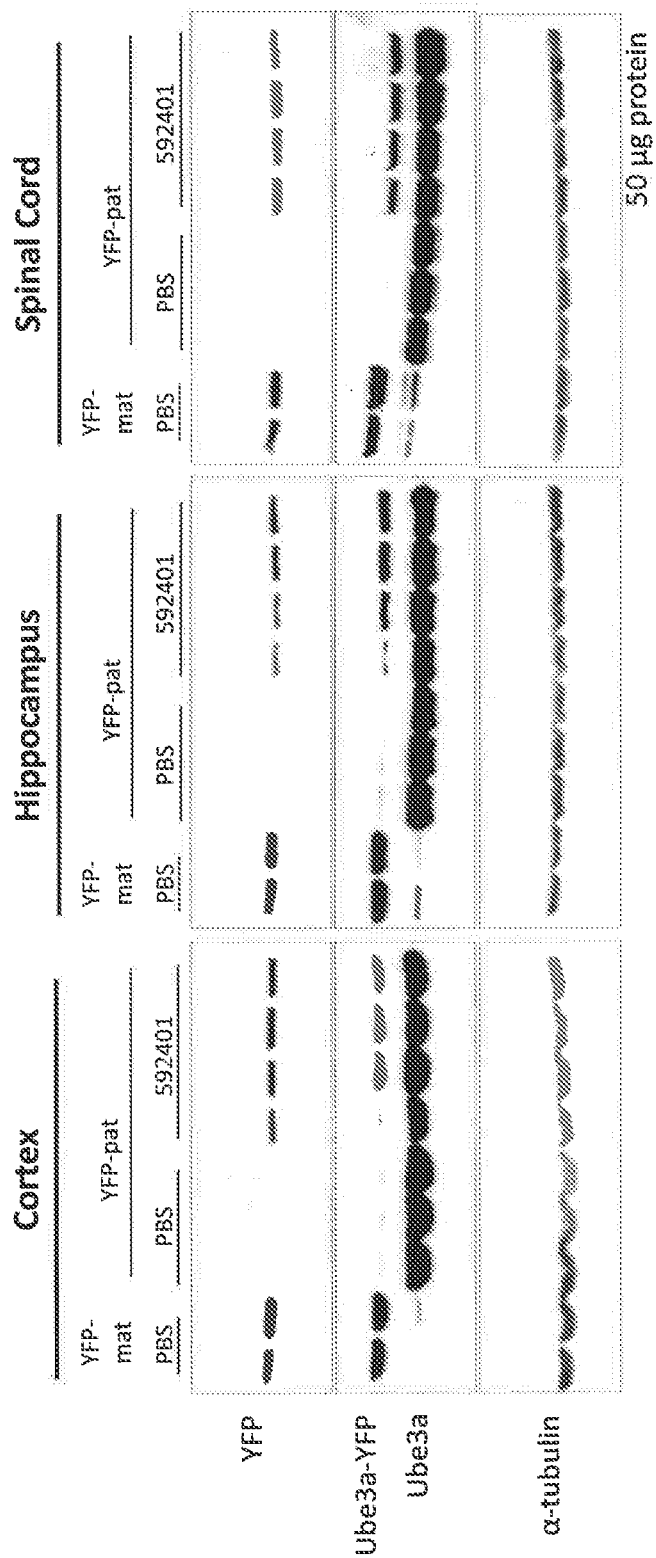
FIG. 2 shows Western Blot analysis using an anti-YFP antibody, which confirmed that treatment with ASO increased paternal Ube3a protein expression.

RNA was isolated from the different brain sections and analyzed by qRT-PCR. The results are presented in Tables 22 and 23, normalized to GAPDH. The data indicates that ASO administration resulted in approximately 65-85% knockdown of Ube3a-YFP-ATS transcript in the brain and spinal cord. Correspondingly, there was an approximate 2.5 to 4.5-fold increase of Ube3a-YFP mRNA in ASO-treated mice. As shown in FIG. 2, Western Blot analysis was performed using an anti-YFP antibody and confirmed that treatment with ASO increased paternal Ube3a protein expression.

The expression of MBII-85, MBII-52, and Snrpn were also evaluated. As presented in Tables 24-26, MBII-85, MBII-52, and Snrpn expression was minimally affected following knockdown of Ube3a-YFP-ATS. Levels of the microglial marker AIF1 were also assessed as a measure of CNS toxicity. As presented in Table 27, there was negligible increase in Aif1 levels, indicating that ASO treatment was neurotolerable.

TABLE 22

% inhibition of Ube3a-YFP-ATS mRNA transcript
expression relative to untreated control

| | Cortex | Hippocampus | Spinal cord |
|---|---|---|---|
| ISIS 592401 | 84 ± 6 | 66 ± 4 | 69 ± 1 |

TABLE 23

% Ube3a-YFP mRNA transcript expression
relative to untreated control (denoted as 100%)

| | Cortex | Hippocampus | Spinal cord |
|---|---|---|---|
| ISIS 592401 | 445 ± 81 | 263 ± 8 | 284 ± 25 |

TABLE 24

% MBII-85 mRNA transcript expression
relative to untreated control (denoted as 100%)

| | Cortex | Hippocampus | Spinal cord |
|---|---|---|---|
| ISIS 592401 | 65 ± 183 | 98 ± 12 | 98 ± 7 |

TABLE 25

% MBII-52 mRNA transcript expression
relative to untreated control (denoted as 100%)

| | Cortex | Hippocampus | Spinal cord |
|---|---|---|---|
| ISIS 592401 | 72 ± 17 | 92 ± 8 | 89 ± 10 |

TABLE 26

% Snrpn mRNA transcript expression
relative to untreated control (denoted as 100%)

| | Cortex | Hippocampus | Spinal cord |
|---|---|---|---|
| ISIS 592401 | 102 ± 11 | 101 ± 3 | 95 ± 2 |

TABLE 27

% Aif1 mRNA transcript expression
relative to untreated control (denoted as 100%)

| | Cortex | Hippocampus | Spinal cord |
|---|---|---|---|
| ISIS 592401 | 104 ± 13 | 80 ± 8 | 113 ± 14 |

Example 8

Antisense Inhibition of Ube3a-ATS in Mice Having Maternal Deficiency in Ube3a Antisense oligonucleotides selected from the studies described above will be screened for in vivo efficacy in a genetic mouse model of Angelman Syndrome described in Jiang, Y. et al., Neuron. 1998. 21: 799-811. The mice have a null mutation in the maternal Ube3a allele. A targeting vector replaces a 3 kb genomic DNA fragment containing exon 2 (299 bp; 3-302 bp in GENBANK Accession No. U82122) of the maternal Ube3a allele, thereby deleting one hundred of the most N terminal amino acids, shifting the reading frame, and inactivating all putative isoforms of maternal Ube3a. The mice have normal neuroanatomy but display a deficiency in context-dependent learning long-term potentiation (LTP), motor dysfunction, and inducible seizures similar to human Angelman Syndrome.

Antisense oligonucleotides described herein are administered to the mice by intracerebroventricular bolus injection at a dose range from 10 µg to 1 mg final concentration. The mice are euthanized and the levels of Ube3a-ATS mRNA down-regulation as well as Ube3a protein induction are assessed using hippocampus or whole brain sections.

Mice treated with ASOs are assessed by various phenotypic and behavioral assays for treatment or amelioration of the phenotypic defects. The open field assay as described in Miller, B. H. et al., PloS One. 2010. 5: e14458 is conducted to assess whether the hypoactive phenotype is treated by ASO administration. The marble burying assay as described in Njung'e, K. and Handley, S. L. Pharmacol. Biochem. Behav. 1991. 38: 63-67 is conducted to assess whether anxiety in the mice is treated by ASO administration. The rotarod assay and the dowel test as described in Chen, M. and Xu, R. BMC Neurosci. 2011. 12: 1 is conducted to assess for improvements in the balance and motor functions of the mice by ASO administration.

Mice treated with ASOs are tested for motor function using footprint analysis. The hindpaws of the mice are dipped into red waterproof ink and the mice are placed at an open end of a dark tunnel. The step length, step width, and left-right alternation coefficient are calculated as described in Clark, H. B. et al., J. Neurosci. 1997. 17: 7385-7395.

Mice treated with ASOs are tested for reduction in seizures by an assay involving scratching a plastic pen across a stainless steel cage, grating as rapidly and intensively as possible, until seizures occur or for a maximum of 45 sec. Each animal will be tested once between 5 and 10 weeks of age. EEG recordings will be performed, as described in Cattanach, B. M. et al., Mamm. Genome 1997. 8: 472-478.

Mice treated with ASOs are tested for improvement in context dependent learning with the fear conditioning assay, which uses a standard testing chamber with a stainless steel grated floor through which scrambled foot shock is administered. Freezing will be assessed and scored as either 1 (freezing posture) or 0 (non-freezing posture). The scores will be averaged over a 1 minute interval and converted into percentages.

SEQUENCE LISTING (225 sequences)

SEQ ID NO: 1 - DNA, 1110944 bp, Mus musculus
  misc_feature (1)..(1110944): n = A, T, C or G
agtcaagtcagtgcagcaggtcctgctcagagaagaggcagccaaagatgcctgtcacatccaccctaggaaaggacaggaaggcaatacagcaaacaaggtcagctcccactttgacccctcgtttctttcatagtagattcatagtagaacatgatttgtgcacattaagttttgcaaatttgttgggattagaacattattctatagatctcaagtctttagctgaagaatcagatgagaaagctatgagatcaggacctggcttcctttgtcctgtcctgtgttgtgttgtctgcagtgcccctccccttcatgcttcaatctgccctgtcacatcagctcagttctcttacagggtgaacattaacatttcaaagagctgacagtactgtggattattggtgtgtaggacaaactgcagtcaggaagaaaaaaagaacaattatatttacagggatgtttcataaaaataatattcctaagggaatttaagtcagattctgctgtgccctgaaggatgggaagggattaaagcacttgagggttaacatagagattatcatcagagggaagacacaacagataatggtaggtctcagttttgggatggaaaggatcatcaggtacatatgacttttgacactatgatacctataacacaggaatgaagagtccaaagtggctttaagaaagagtagtggagagtaaattcaggtgtgtgaactaccaacatatgaaaagatgggatatctttcacacacacacacacacacacacacacacacacacacacacgtatacagtagtagagaataaacctttttttctgtgatttcataatgtaatctaatttgaatgtttacagtcctttagtgtctttatatatttgttatttattattattattattattattattattattattattttgttatgttgttcagattaaacaataaactagtgaattagtaagaactttctttggatatataatgtatttctttattttgctttgtcccttgattttactgaagtttatagatattcaaaatagcatggtgattttttgttcattttccatcagataaataggaaagagtgtgtgttgtcttttgtttttgtttttgtttgtttgtttgtttgcaggtgtttttgtaagtgtattttgtttttcattataaaatggtgttgtattttatttttattgaaaattaattttaacacaataaattacagttttctctttttccttctcctcccagttcctccctacctccctttccttctaggtccaatccctttctgtctttcattagaaaagcacatccaaatgatagcaactaaacatagcaaaatgaaatataataaaataaaccaaaaacataatgttgtgggtggagaatgcaacctgatagaaggaaaagtaccacaggagcaggcacaagcataagagacacattggttaacacattcaggaatcccacaaaaacactaaactgaatgttatagcatatgtatagaagacccagtgcagtctattgtaggctcctgaacagagaggtacaaagagctatgtcctttcgcaggtatcatatatgtttgtatgtgtgtgtgtgtgtgtatgtatgtatgtatgtatgtatgtatatatgtatgcaatttatatatacatataattgatatataaataaataatttatatatgaatattatgtacattacaaataaaaatataacaatgttatgtataacataaatttatatatttatataatgtaaataatactttgtctatgatttctttctcaaactatttatgtcataaacataacatttcaggtttttttatcctggaattttgctggatgtggttattagcattatgcagtttctggtggcatatttagcacatttttttacttatagaatcatatcatatttaaattataattaattgatttcggcatttcctactcctatcgcctttatatctttccctcttgttgcttacctacgactcctaatactgtactgaataagacaggaagtgtgaccttccttgtcttgttcttaatttcaatgaaagtgctttgagtttctaatcatttactaggatgctatccctgagtttgattttcattgtcttattatgctgaaatatactctctttaccattatcagtgaccacatttctaaggaaactggacacttgctatcttagtagtattcgttactatagaaatgtctgcaggtagggttggaatatttagagcaccttcatccttccttcttgaatttgctcttgatcttcttggggtatatacatttaaccataacttttggaggtcatgtttaaacagtcatatcatttatagagaaaacatttctgagtacttctccaatcctctagcattcatttagtttccacaactttttccttaatattgtttgaccacagtacaggttttggatgtcccaaatataactgaataatgacagttccttattctcaggattttaagtagttattcacctttgtgctaatcaacaccaactctcataagagtctaatctactcaaagattcaccagcatgtaactatggcaataaacagaaatatttaaatggaagtttgataaaatgaccagttagaaaaataaaattagtatgttctctgctaagacctaaaaattcctttggcatgtttgataccagcatctgcagtatcattcctgaattctctcctgaagaacaggcattgatttctaatcaagactgtggttgattactcgagtaagtagtcttacaacagttgcactatgaatgcattggacctggcaggtcattaatgtagcatgaaaagtttagtgatggataagaaaattattaattttaaactacttagaaaatgcagagagacattttctagcactataaagacagccagcatggaaagattcctgggtagttaaatgtgggtttctccatcaaacaatatgtatagtgtaaggcatataacatgtcttaccatgaagttcacatggggcaattgagaaaatgcgtgattgttggtacatgctttctaggattctttgacttttcttttttattattaattattttaattatttactttccaaatgttagatcccttcccacactcccctacacaagcacccaaccccaccgacttatcatctaagcctctaagagagactctcctatacacccacccactcctgcctcacacctctcacatcacccttcaatggggcatcaatcctccacaaaaccaagagcctcccatcccattgacaaaaaatgagataatcctctgctacatatgcagctggagccatggaatcacccatctttactctttggttggtgggttagtccctaagaggtataaagcatctggttaattgacattgttgttcttcccatgggcttgcaatccccttcagctccttcagtccttcctctaactcttccattagggttcttcgggctcagtccaatggttgactgtgaggatctgcatctgtcttagtgaggttctagaagagtgtctcagaggacagctactgctgtcaacaatcacttcttggcactagcaatagtgtcagggtttggtgtctgttgatggaatggataacagggtgggacagtcactgtatggactttccttcagcctttgctccatttttttgtccatgcatttcctttcgacaggaacaattctgggttaaagaatttgagatgggtggatggtcctattcctcaactaggggccatgtctatctactggatatggtcttttcatgttctatctccctagtgttgggtattttggctaattgccacagacaatctgggtccctggtctgtgaagaacgggatttcttaggcagatggacaaagattccggatgaaaatgacagacagatacacgaaagatgtgttgaatctgaatgtaatgttctggttgagcttcagacttatataacaacgaattatcagaagatacaaatcacaaaaagacaagatacactgaaattcaccagttacagcagaaaggaatttacagggactaattaaatgtttacattagggataacaagccctgcctaggatcagcctaatgccaggcaagaatttcacactttaaggttaaaagcatcagggggttgttaactcttgacaggccttaagagtaatgcactatcacagagctctaaattcttaggtctagtaaaacttatcttgtctggagagtttccccttatcagggtagtatatcaacttatacttgacatggaagtagcctgtagtaaaagatttctatctcagtgagacttttagtctctatctgtaaacagctgagtaaaatggcaagtgcttaattgtttactgaatgggttaagctccttgctgctatctggaatctaagaacactggaaaaaggctttagctatgttagaatacaatcttaaaaggcatttactataaggtaatactatatagagtgcacgtggatctatacactagactaatgtgggaatggaaaaattaattttatggtttatatagattagggagaaaatgccaggcccccgggaagggagtttccttgaaactctttgcttcatgaaccagcttcccagctttcgctttgtcaagctgactccaccagagtccctggcagctaatgtcatccttattgggtcctaggagcctctcacaaccctggcatctgggactttctagtgggccccctgtaccctccccctgctacacatttctattcattctcctgatcctctggatttctaccctgtttcttctcataccacaaacctgattctgctaacctccctttccctccctcaccaagttccctccttccctctgcctcccatgattattttatttcactttctaaatgcaattgcagcattcacacgttggctttccttcttgttaagcttcatacaatctgtgagttataccatgggagttctgagattttgggctaatatccacttatcagtgagttcaaaccatgtatatcctttggggtctgggttacctcactcaggatgatattttctagtttcatccatttgcttataaaatgcataaaggcattgtttttgatagctgagtagtattccactgtgtaaatgtaccatgattttttttgtgtacattcttttgttgagggatgtcttggttgttgccagtttctggatattacaaataaggatgttataaacataacagtacacatgtactttttatatgttggagtatcttttgtcctcatgtagaaattgctagtcttttaaggaactagaaatcactttggaacgttatttccaaagtgattgtaccagtttgtaatcccaccaacactgaaggagtatcctgaaacacatggtacagacttatatgtgaattattctctctctctctctctctctctctctctcacacacacacacacacacacacacacacacacacacaaacacacagagcctacagattccataagataaatcataaacacggaagagggtcacacaaatctaaatacttcggccttgtgaataccagaaatctcccttacatctgagactgaacaagaaataaaaactcaaggctagttatcagatctacttatcacaaacaatctccatgaaaattgccacaactaaggatgagggacatctaagttctttccagcattcggctattattaataaggctgctatggacatagtggagcatgtgtccttcttatcagttggaatatcttctggatatatgcccaggagaggtattgatggatcctccggtagtactatgtccaattttctgatgttcttttatcattgagaagagtttttgctatcctaggttttttgttataccagatgaatttgcagattgccctttctaattcgtcgaagaattgagttggaattttgatgggaattgcattgaatctgtagattgtttttttgcaagatagccatttttattatattgatcctgccaatccatgagcatgggagatttttccatcttctgagatcttctttgattttgttcttcagagacttgaagttcttatcatacggatctttcacttccttagtttgagtcacactaaggtattttatattatttgggggtattttgaagggtgtggttcccctaatttctctttacgcctgtttaggatgtttatcgctgggatttcatgtccagaatctgggggaagatcagagattgttgagattgcatgtaatgagcatatgcttttcattctctagagaaggtgctcgttctggctgtgagaggttgagaatgtttggtagttagaatctggtagtagaaggtcctcagggaaggggtctgaacattagtaagctagaagaatttacaataactattcctagatctgtcatcaagaattaacagataactaagtacttttattatgtggactgcatttagtgatttttggtgctatttactctgtgccactcaatgcaggtattctattttccacagccaatacaaagaaataaaggaagtgttggaaagatgtgtctcacctcaaaccaaaaaattttctacagaaaagaagattaacataagaacttagataaactttcccttacagcatatggaaataaatatttagaaactaggttttagggaatgatggtcaaattaagatgttaaaaattgatgattattgtataaatgtgaaaaatctcttttcatacaaatatacaagaggattctacattgtaacaagttatataaaatcttaaaccaagcttataatctatgttatagatgtgttatcatactccataacctgaaaatatgcctctattagatacatcacaaatatacatggtcatatttagtgtgagaaatgaaccacagtaaatcagagcaaggaaagagaatctgtcagtgacaaatagaactaagtgacttaaactttctaatgattaaaaaaaatatggcatatatatgacatatagaaacttctagttctgcagttttctgaagttttgactcttatgaaaaactacttttgcttggtggatgttataataccttattggtattagaagtgttgtctctccacatattaaattgtcttcatattaaaataactgtggaccttgtcttggtagtttccagttagttctcaccaactttaaattaacaagggaaggggagataaggaaggtggaatggaaggtcagagtgtgagtgcgggcaggagagtacatcaaatcattactgaaagtactttatcactcagagattcagagtcattagtggcaaacaagaccctattgtagaataaaggtgtgataggacatggcccaggaaacagaggcttgtttccttgcatccttaaaacctctctacccttccctcacatttgatgaacatggtagggctgaatcaaactgatcatccttgctcagagttaatggccaaggaattttgaatgtggtctattgtacagaaacatcaggaagagtctttgtatcaaagtattctggtttgaaactgcaactatagttatagcatttcactcatcacatagttttttgaaatcactacctgggcaacccctttgcagggagtaaatataccttacttagtggggaatatgattgcccacctctggctcaggattaatcttctgcacctgtaatttatattggatgtggtaaggaaagaccctcacaactatctgcaagtggagtttggctactttgctttgagttcttagaaagtcacaggtgcacaccctaccatgagctatctcagatttgcagatcacacacacacacacacacacacacacacacacacacacacacacacacacaagttcatttttaaactgccttattggctctttggctgggctcttctatgccttccttggctagtatgctcttatcttttctccttgctcaacacctctaactcttccctcaatatagctgctcagttacctttactcctacctagctaaacacctctaaatctgccctcaacttagttgtccaactgctcatactcctatctcaacatctctaaggacccttggtcctgagaagatttgaagctccagagtaaggggatactggaggggtcgggtgggagatgatgggtgggtgggtgggtgaataaccttatagagagcacaggagagtgaagggagggaggttgtggattggagagcttgtggagggggaacctggaagtgggatatcatttgagatgaaaatgaattgaatgattaattaaaaaaaaacaatagaaaaaaatgttggaatggaaagtggtgtttttatagtcccaagccattggctgaatatcagtttcttctgtctctggtccagacctctttctctttttagtaggttatagtagagcccttgccaaagcctggagtcagctcagaactggactcccactaggaacctgagtgacaaagtcctgtgttcagggatgtgtgttaactctcatgacctctgattccttcagtctttgcctgaaaataaaaacattaaagaccaaccagaagaaagatctgatatttaggaatgaaaagcaaatgtgtgctataacaaaggagatctctttcagaactactgtttcatcttgttcttccttcttgtatatagcaacaaaggtgtgtgtgtgtgtgtgtgtgtgtgtgtgtgtgtgtgtgtgttgaaacactttgaaatatctgctcaactgttctaaagaagtatcgggtgatcacaaaaaagtcacaaaaatgagattataatgccaagtaatcaaaacctaagacaatgggagaaaatgtaatccattattaacaaatatattctccacagatctatgggtaaagaaattacaaaatgtgaactaatgtcttcataatcttcagtcattcttttttatccattctactttgatatattgaatctttttcatgaaatatttctcccttccctcccatttgatgaacatggtagggctgaatcaaactgatcatccttgctcagagttaatggacacatcaatattggttagtgtttgctgaaccttacaaggaacagtcataccaccctgtccagtcagcaagtgcctcttggcaactgcaacaatgtcaggtttgttgtctgcagacagggaagatccccaggtgaggcagccctcggatggcccacccttcagtctctgctccatttgttgcctctgttcatgtgaatttctttgtgtcagtgttaccttacacaggatcataatttctagttccatccacttgcctgtgaattctgtgaatacattgtttttaatagctgagtagtactctggtgtgtaaatataccacattatatgtatccattcatgtgttgagggacaaccgggttgtttccaccttttagctttataaataaggctgctgtaaacacgaaggatcatttgtccttgttatatgttggggcattttttgtgtgtgtttatgctcagtagctgtgtctacatgtagaactatttccaaatttctgaggaatcaccagactgatttccagaatggttgtacaacttgcaaccccaccagcaatggaggagtatgatttcattgctggacatttgtttttgacaaataaacaccagtgtggctttaaaatctgtcattaatgagaaggcttgcagtcctgcttcatctgctagaaaggcaattcacttaagccttcggtgtctgacaagaacaggacacctgatgctcctcacacaccttcacataataaatgaagaattttgtcaggaacagctttctgctggcattttgagacttcctcgtggcttaagtcatattctttcctaaattatctctcctgtgacacagagatttctgagagcaaagaatgataatatttacattctctttttttgtgaccctattaccatcagttgtctttttaaatatttttattacataatttcctcaattacatttccaatgctatcccgaaagtcccccacaccctcccccgccacttccctacccacccattcccatttttttggccccggcgttcccctgtactggggcatatacagtttgcgtgtccaatgggcctctccagtgatggccgactaggccatcttttgatacatatgcagctagagtcaagagctccggggtactggttagatccccttagctccttgggtactttctctagctcctccattgggagccctgtgatccatccaatagctgactgtgagcacccacttctgtgtttgctaggccctggcatagtctcacaagagacagctacatctgggtcctttcgataaaatcttgctagtgtatgcaatggtgtcagtttttggaagctgattatagggtagttgtcttagttcattcttccttcttttcctccattcataaaatttattgcagttggtatacggtttaaaagttcaccaacacacaaatagtactaaattaaaccacattatacagtattctccctcgggaaacaaagcatactatgattgtcaaagctagatgtcagtctaagatttagaaaaaggaagaatgtgaacctaagaaaaaagaaaaagaactgataatgacaacaaaaaatccaaaaaagcctgttttgaacattgattgtctcctctaaattaaaagattattttagcataaactgtattaaagacaaactagaaactcttcaagtaactaaagataatgctccaaggccattttcacagtttcttttgtttgtttatttgcttgttttaaattacattacagccaaattcacatacatctgatgaaatatttccaaagcagtccagaaacacacaatggggttttccattcagtatcttaagagcaaaaataggctatatttacagtagttaaggcaatcaaattttaaacaaaagcaattaaaaaaagaaaaagggaaaaattgttttttcacgctactcccttagatcttatttgtaattgcaagacaggaaaacagtgtgcaaaatgcttctcccctgcacactgggcatcagaatcacacatggggctgcagcctcttctgctggtacacagtcgactatcccactttcccatgtcaatcaagacagttcaatcctttcagcctgcgcctttgttttcagtctatagaatcttttcatgacttagtggatagtgagaaggaaataaaataggggaggaaaaaagggaagtaaaaaggaggaagagagagagaatgacctataacctattgttaaatgatgcattagttattcaaaaaacactcagttggttacatgtgcacacctaaaccctgagctggtatgggttctatgcaattacaagtctggtatgaatgcacgctgcacatgcaattctttaagccatttgtaaacatttatatgttccttcctagtaatatattgaagttatcaattttcaggttaatttattattcagcttaacagtttcaaacttaaagatatgggaaaagtaaattggaaagtatataaagtaaaaataaaaacagtgcatttatatgcttcataacaccagtttttttcaaatgagactacttttctaaggaaattaaatagttttaaactcactcattaaagttttacaatgtaaattaagacaaaaaatatactgaaactcatgcatttctgtggtgttaatatttacttttcaagactcaactaaatccatcaacacaatacaccctcctagcccttataattaattacagtacccaagagtagtaattcatattacagaattagtttgtacttctaactccggttctatccccagttatatgatgtttctgtgctgtctctaataataatttccagtttttcaccctgacattgtaacccttttcagtctttgagaacacataatgtaagaagctgatccatattcccaatggggggcaggaaacttggcctgccacgtatttctttattattttgaatttcaatctccaggtactgatcaaggtttatcagtgtattttccaccatgcaattcagtttgttatgccaggtgtgttagtttagttatattgcttcttttgaactcttttgtggcacagccattttcactatagtgaggagaataatgaagccactagagctgcttaacacagctctaccaaagctaagtagatttctacaatcattgttctatccccaacttctgggatttggtctcggtgtgctgcattactggacattctgcatgatggatcattttatgtcttttcctgtgaaaaaaatatctgagtctttttaggaaaatccttaaattaactttctctggccactatttgaatgtatcctttatgcccggctgatcattaagcacacataaacacatagctccataatgcctttactctaggagttttcttgtgatatataactgtgagtgaacttaaacagtgtagttaatgcagagtagagatcaactctgacttgccaggagaataggttacagatttaagatctctttttaatattcttagaggtctctataaatgtacttaaaaatagggagtctgacagtatacattcctgaatgagtaaaactcaataaataaaatagattaaatgcattctgacatggtatctgagttcatatatgcatcagtcatgtgtctatgagacgtcctctacttggtgacatggactacctctggaacttactagtaatctttctaattacttttgttcagagatatctgtgtacttttaagtgctcagagtgtcttgtgttcaggacattgttcttgttgtgtatctttatttcaagagtatatattccaagaagcttccctgatattgtggatcaatgaactgactttttctcttcttacactgaggtagcaatttgattaaatatattaaatgtatttttatatttgaccataaatttcaattaatattttatcacattttatcaaattttacataaaacactgtaactttatcagtgaaactggaagaaacattaaaaattgtcttagaagcaatagtgtaatatatgatggcaaaggagacagataccgttctcaatgttactatcttttagtattcacacaggtgattgcttacatacccattagctcttcaaaatgtaccatagctatcatagcttgcaaggaggctgtactagagaaaaagtactttcaaccaagaagtcctgtgggattgtcattttaattaatttttattttaaatcaatttattctctgaaaatttgtacatttataaattggatctttatcatatctactctcattccatatctagtctccccttaaaacattttcctcccaatccatgccctccttttacagtaaatacatcatttatgtataaataccaattactccaaatagtgttgtccttctatatttgtggtattacaaccaagaataaagctaccaacatgttcaatctggtagtgaaatagaagagattgggacagagtttatttttgaagagaaatgcaaatccttaatagtaaatgctcagtgtaatttggagtattcccaaagccgaccaggtatacttgcctaaaaatggttctgatttagagtttttcttaaaacctcatataatccaattcagataaagcctttagagtatgatttgctgcacaggtttcatgtactatatcatgtagtcagttgacaaccatagttgacaacaactctttgtttgcttatttatttataacttgctttctttgttcatttttataaagcaagctgttatttccctattcctcatccacaattgttcaattcaagctgatggagatgcctataatcagagccatgatagcatagaagattgtgagaaagtgcatagtacaagatatgaggacctttttagaagtcaacatttccttcactggatagagttattgtaggtatattgtgtgaaacatttgatcttgaaatgatatacatacaaaagtctacctatcaccttacatagttattttagcagcacaaaaatgtcaaatttcacacatattcaataacatttgtgtgattgaagattactttgagattaaagcagcattttagttggttaaatgtacattattaggtcccaagtgttgatatattctatgaatttgattctctgtgagtcctgacattaggagttttattatttatttttccctagcatatcacaattttctagatatacatgattccactattacaaggagacagtttgttctgttcaaatattatcccgaaattctcagatactttaacaactttcacacccaacaaaaaggaaacagaggccaagtgacatacttagttcaatgacatatttacttaaatgtcttttagacgtttgtgtgatcttttgaaagttgcttagattagtacttccacatgagtagttattagcacagactgttctagaatgtcttcttacacatttgtatgtctttgacgtatggattttaggataggataccctgatagttattaaacaggcttgacaaaaataccaagaagaaaaaaagaaaagatgaaagagaaagggtaaaagagcctatgacgacaagttgtagcattttcagaataatataaatatcagagagatacattaggtaaagcctgaatatgtcactcttgtagagtccagtgaacaaaaatatttaagggctaggttttcaaaaatctctttaggcaggcaattatttgagcaagttccagactgtattgttaactccttaaagagtgatggtgtggatcaaaccaacagtgtggacagctctgagacaagaggccgcaagacaactgagttctgtccagaccaggttggagagtccttacaaatgtgtcttgctgtgcctttagatcacctaagttctctacctcactgaagctagaaggaacaagacttagtatgttgagatggggagaactgccatataagctgaactcctatttggtttctggattttctaggagttttccaatgatcttctattcaaaatggctaaaagtttggctcagcaaataagaaccttgagacctgtcacattatcatacttgttgtcaatttcttccatgcctgccagctacttcatgttgttgatgtaacatgcctaccagtcattgacacagaaaaataacttgaatgatagcacggacacactgactaataccctcttattttctgtatgtcatgatttttgttaagcttaagaaactctacaactgtaaacttcacttagtatccatcaaattaaaagtcaataagaactattatgtcttaaatagcttgagtcagggctgaccagaaggcagagctttgaacagctgcatatgagctcattgtgtgctttgtggttatggcacttgtaagctcacactgagaaatatttagggatgtatttttcagctcaagaaccttatatgtccctgagaaattagtctcagtgcgttccttcaaaaaattgtccctatctgactgaaatccgtgttcagctggtttgtgagcaacttctgtaccccaataggacatacttacttttgttcatggtgtaaatttctgaaaatgacaatttagatgcagtaatgggatttctgttttgtgacctctaagtatattgaagatactggaagttagcattgatatgagaagagatgaagtgagtatgttctttgtcctgtataaataagctagctttgtgtgaaaacaggaatgaaatgactctataatgctagtcattgtgaatgtagaaaatttctcactgagtattttgtggagaaggtgagagctgactgaaattttgagtattctaaaaatttagataagataataggaaaatgcatagattgaaaattgttctttatagcatgtagcaaacataaggagaatagcaactttcactgtgtcctattatatatgaaagaaagttgacaaaatcactcaatttcacagcagtgagtgttgtggttatcactaggcaataggctttttagctctccatgatcaactagagtgtccaggtccactatccttcaaagcaatcacatagatcccacttttcctcatgtgtgcttgtctatttcttgtcaccaaatgtttcctaaatcctgtgttggcctatattaccaggaacatggattgtataggcagtgtataaactttgtaacacttttggtgagtgtaaatgtagaagaaatttgtatctgcggtgggctgttctcatatctcaatgtgtattagaagtcagaaagcaacttgaacaattcagtttttatttctttacaatgtacagaacctggggaacaaatttttggcaacagcctctgtggaatgcaaatttactctctaaataatcttcctatcctggtgcactagtcaggacatcacctagaatcaccactgagctctacagaagcatcactagcaggggctagcctccagccaggcttcagtctgtaaatctgttgtccaaaactgcataactcactgttgtaggatatttgatcacgttatgaacacagatattgtgtaatttactgaaaaaatactctttcggattatggtgtcactaaacccttagcaaacaccctgaatccccttagtgtgcaccaaatactggatctgactttatttgacttaaagtacatgagatatcctacttagtctcagccatgatctttcatttttcttttgttgttttcttttggttttaataccagcttaccatgaatccccttcaatatgtttttatatacttttactgctctcactgaaacatttctaaagacctagctagggcaaggaatatggaaagacacaaagaaaggaaagccagaattagggcacttgtgatatgaaaatttctttgctgaggttaattttgccacacttcataaaatttagggcttcagtttacttaaccactataggaagactcacaaaaacagaaggacttcaaaccagagtgctaactaggtgaaattctgtaaggttatttttggagaaaatcaggtgcagtttgttgctaagttaaacacaaggatcccccgttatcttttgttcaatatcaaacagtttaaaacatgtccaacactaatgtacttgagttttactgtaagggaagactgtgagtttgatatggtcattaaagccacacatttgacagccatgctggtctttcaagatttctttgcagactcaactcagtaggaaagcatacaatgctgaatttccctctttacatttttctatgccaggataagatgtatatatgctatatatatagttattaaaagaaatgcatttcctcaatattattactatacataaatgttatataatgatatgcataaaatgcagactataggacattttatttaaaaaaaattccaaaaacaaaataatttactgcaatgtatatatacgaagaaggaaaactaaatgggttccacaagtttctgtgtgtgtatgtgtgttcatcacttcaatgcatgtcaagcatgttcattttcacccatatactcaatcatatgccaaaaaatgtgtcctgtttcaaatccaccatctacatattctatgaaaggaaagaagcacataatatactaaactgaagtaatgtttatttcatataaacaataaactgcagaatttagacagaactattaatctaaaaattttaaaagtgttctaagaatattccaaggtaccagtatataagaagttcataggaaatatctaatcattttcaaaaacacagcaaatgagatggataaaacagaataacatatcagagaatactgcagagacacctcacatacactttgtctatagtcattgcatattcatgggtgataattagcctgtgttccatttgtgacaatgtttgagaatcattgttgcaaatactacaacatatgttataatattctgcactccatcactagccacacaacaaaccttttttgttgaaattgtcaaattgtgaaatgtattcccaagagtttgtgaataccaagaatgaatgaactagggtttgtaacccccttatatacatggatataatgaaaaattatcagaccaattagctatctttagatacccatgaaaacctctaatgcagggattgagtcacatttaatttaattggcagacagtggggcttcaatgcaatcctcaaaccatccaaaaaatttttaatactctaccttgctctatccaaactgtcactaaggaaccattgatgaaaacagttcctctattgaaaacaaagttgctgagctggcaagggaagatacaaatgcctcacactattactgaggctatgaagtgctcaaaaaaggaatctatcatgactgccctctgaaagacccaacaaacacctgaaaagagtcagatgcagatatttgcacataatcaatggaaagaagcagatgacccctgttgttgcatttaggaaggctaaaagaaactgaggagaagggcaatcctgtagaagaactagcagtctcaatctgaactcccacaatctctcaaacactggactaccaaaaagacaacatacaccagctaatatgcagcccccaacacatatacagtagaggactttcgggtctgtgttcattcagagatggtgcacctaactctcaagagactgggggccccatggagtttaaaggcatatgtgatactttcaggcccattgtctagtagtttggtttgtagtagtcccaagattggagcaatcagcgaaagggagagagagagaaaaaaagagagagagagagagagagagaggccagtctcagagagagaacccaggctcagaggaaaagacaataagcatagaaatttaagatgttgattgacagaaatatttatctggaatatctatgaaatattatgctactgtaactaaaatattccatttgacttttttatttaaagtaacttgctttctgttcactgtacatagcatttatacaaatcttgagaaatctaagaacagtatgagatgagtagcagttatccctataataaatagtactatttttgctgatcttttcctgggctgtattattttgatccccttttttaaagtctcaagttgcaaaagtgatgcaggagagatattaggaaatttctcaataatcttgcttgtgttgaaagaatggagagctaaacaccaacttcagaaccataatttaataaactacagcatcataaaacactatttcaatattagccatagctaaaaggcacttaattcctgcaaaactgaaaccagtgtcctatagaggaaccagagaaaacagggaacaaagagagctcccatacatatgcatgctccagtagtgggcagtagtcattgagtagcaaggtaagcaagaaagacagcagctcctatgggaaggggagaagagacaagagatgtctaaaataaacagtaggaaggaggtgagaaaaattctagttactgagaacacaactaggaatagctcagaaattcagaatgcatgatagcttagacatttccatggtaacactcatggtacatggggtgacacctaatgaggttcagtttatcatgtcttcctataactggaaaagaataatggaaacatgaaaacacaaacaaatgagtgactatgaaaatgagtccaagaaacacaagacacggattggtagctatcaagacaaacaatatccagataacgtcttgatcttatatcagcatcctgttataggttagcaaactctgagcaagcaacactattttctcagtcaatttctcttactagcaggctgaaacttgtggttacaaagaatgtataaattattttaccatttatctttaaaagtaatcttataaaaactttaaagaattataaatctgaacacatataaaaagtcatttctactttaattattcagcttgcacatataatcaacattgttttattaaatcataaaaagaagccgagggcaaaaatcaccctaagaaatcaattatcagagaactgaaggagctgaaggggtttgcaaccccatagagagaacatcaatatcaaccaaccagaccccctaaagagcacccagggactaaaccaccacccaaacagtacaaatgtagcacaggatagccttgtaggtcatcaatgagcggagaagcccttggtcctgtgaaggctgaatgagccagtgtaggggaatgccaggactggcaggcaggagtggattggtaggtagggaaacaccctcatagaaacagagtgagagggaatgggatagggggtttccagggtataggaaactgggaaagtagataacatttgaaatgtaaataaagaaaatatccaaaaattaaaagatattaatcaagagctgggctttagaaaaagaggcaggatagctagtgttgttctgactgccattgttcctatttcttgacctcaaaaaatcactagtcaataattaagactgtgtttttctgaacttcaatttggtctataaatttaatatatcaacaccactaacaaaagaacaaacttcgtagtgtaacttcattaaaaatctagttttcaaagtactttccaagcatggagggcattgctaaaaatgtacgtatcttagctttttccatgagtggaaactaaatcattaatctgttcaaagagaaagatcaggcagacaagggccagtgatactgtaccgtaaggggctggtagttcactttacattttcatacaatcttttttgtcattttttttttggtaactggtcaagatatgaatacatatatatggtttactaaagctttaatcaataattagtcaataattttattgatataaaaagcactctaatatgcacagatttgtgtttttaaaacaattttattttaatacagtttaattaaattataattatatcatcattgtatcattttaacatttcttttctccctctacataaatgaattgggccctcttcactcttaaattgatatcttcttaaaaacatatacatcatacatatgtttcataatattggctcatacaattgtcaaaatccatttttattaattctccagtttctaatatcttatcatcattcttttgtaaataatttttcttactgattttatcaatacttaatgcatctatattattgaaccctgatgttctgtctattgttttactctcttttaatctccctatgccacgtgctgtgaatgaatagacaaagcatcttaaacatggaagatggtattcctcaaacttgatgatcagaaattccctcacaggaaaccagagccacaaagttatgatacaatgggaaatttgctgaggccctataacatacaaagtctatatagaaccagtgtcatggagcacagtgacagtagcatacctgttaggaagaaaagcctgaccagataaggggatttctcaaatgggtcaggtgttattctgagaatagctctagtgttcctgtgatggtatattcagtctgaagatctaaaaacactcctcaagggcagaatctgacaaaaaaattcttacaaattatatcaacactattgtgactaaactgctggttttctatatctttatttaatgcaaagaatgctatatttggaggctcatgcatatccatcgatttaaaaaaatacaaacactaaaagagaaaggaaggaggatgttagaaagaaatgaaaataagaaggaaagaatggaaaggaatgaaaggaaggtataagggaccacatttgagaagaagagtggactattgggaaataaggaaggggattgtaagtaactgaaaaatgatgcatggcatgaatgagatcactggaaatttgaactttatgatttgttcaaaaagtatacaactgaaaatttaataaaactaaactaaattcatttcattcaccattctagtttagaatgtgtagttgtgaaaaaaatcattgaccaatacgaacatgaagaaaagatggttatatcatctaaaagtcctagggtacagattatcactgaagaatgtcatggctgaaaactgcagagaatcactgaagtgatgaatatggcgctaaactacttactaacttgctcgctatggcttactaaactatcgtttatttattagaggatcacaggccaaaatgaaggcactatttagagaggcaagcagaaatgtttcagggcaatatatttatggtgtcatgactggaatagcataatttctcagtgtatcacttgtactgtgcagggatcctgcttcactagcaagtaatccatttaacagtcattctatggtgaggtatacaaaaacagagtaaaataacaacttgagagataaattttttgcctgagttcactgtttagccatcactctaggttctataatatccaaatctaaacaaaatacataatcaattacctgcctcaataataagaattttattttatataatataatgactataatgtgtaaaatcatgtatatgttagcattcatatcagcaacctaagatctaaattaaactagagattttctagggctaatgtacaaacaaaatatcattaataatttttgctgaaaattgtgtcatggtgctgcctctgccctggaccacccactgccagaccctacttgcctttggggttggaggtgaggtgaaagagaatcaaggcacatattccagaagcagttaagaaacaactcagcaagctcattctaaccttactgcaagctctatcaataccttcgacccatttcccattggtcccaagaaagcgtccctcctaaacagcagttcctgattggctgtcaatggctgttgcagcaaaccttgttctctcaggcagttttaagttagatcctcctgcaggagatgcctttgtggttgtgtgaccaccataatctatgcagatgtggttgcactgtcccatatacatttccattcttttgtttttactttttgacagtatagtggaagctggggtaatattgccttaacattgttaactccacttcagaggattccaagcataatggattgtgtctgtcttagtttgtgtgtcttccagaatcttatgcattattgaccaccagcctcaaagagatatcactctggaggcaagggggagatgagaaacggcctacatactagtctcatggatgtctgccatccaagctttagtcatttcattaggaggttgcaatctgaatttttgagagctttctgcacattgagggtcacgttatttgtggtgcactgcctggagatattttgggtgagacacttaaacaaaattatttttggtgtgacaactcccccctcatagtgcaagtaactatcaacgaggggtcaaaaagcctcttaatattgtcccacactgctcccaacattcctacatctagagagagcacagataccctggttatattgtggttatctatgttctacattaatagcacagatagttaaggtatttgtctgacaaggtaccttcaagatattgaggcaaatgttgtcaggcctcagtggtgttatatacctgattaagggataaggcagattggtgaaatctggggaataaagtcctatcccaaccaagggccaatgattctactagtatgtcaatcagttgttggaaaatgtagatgtcttgttaaagatgttcatttagtacctcctgtccctgtagtacctcagctaacttagagaaaaaaacattaacagtctcagctgtggtggctgtctgggtcaaggcaagaatagctgttattaccctggcaatgccttcagttaaagccacagtggtggcagctgtaaaactaaaatccccctttttcctggtataggggttgtgagtctgggccatctgggccagtgagtgtcagcttgaaagttggtgatatttaccaaaggcatccaaatgctattccccatcagaatagccattgttgaatactgttcaggagattatcaggagacatttttcattaaaacagttaaggctatctctgacaatggaggtattggtggctagaaagaagaagggacatcagacacagactggagtggctttccaaccaacctggatgccaatggtcacattcatgcagtcaccccagtgcacaatttctccaacaggttcatatggaaatacaccacactaaagaggcagtcaccatttagaagagtaagggggcataagtcaagacaattagaggggccacataaatccctattgatcataatgtggtcataacagcatctaatgtgatctctattaacacagaaagtaatattggaagcatcatgtgagttaaactttgacatgccaagtgtaaggttagaagacaatattgggtattccctagctaattttatgcctagtgcagtctggcagtgctctcaagggatagaaagttcgaaaaaagtggtcatttgaggggtcctagaacagtgaggcagaggtggatgtgatatttttcaggatttttaatcagtaagggaatgtgaagttccatgcctgacatgggttatattactgtgaacgtcccacatgaccatattgtgtagttgaatacaaggaccaatggatgagacattggtggtaaagcagagaatttcctcagagtgccaggtgccttctaatcactgtgtagtagtgacaagtccaagaaaggcaaagttgttgaaagagaataaacagggtaagttagggagttaacagccataggcaaataatggggtctagggggaacatggccaccaatgcccagagctgatcagtcttcccaggctaaagaaaaaataataataacagcattatgatatatctccgaattcgttcttcttctggcttcttaaatgccccctggtctgtggctagacaaacatatcttgagggtaccatagtgtcacccttgcattctggggggaacagaaacataactttgcccccttgacattaaaagagtgggccgttgtctttgaaaggctattgagtcccttcatctaaccaatgggtgggaagtgctccattgcaaaaacacccaatgtttgtaagcagggcccattcctttctcttcaaaatgcagaaagttcacattgaacatgacctccactaatgatagatgtggatatttttagggtaatgtggaggtgactcgagcaagtgcttccttcaaggattcactctttctaagattgcttggccttgatgattataggctatcccaaagaagtgaatgatcctccataagaataagaaggtgataaatagctgatatgagtaagcagccccattgtcagtcttgagtgcgcaaggcactcccattacaaatattaccaattttatggccttattagcatgagaagtcttttcacctgccatggccactgtgtatatgaaagcagagtaagtatctatcatcacatgtatttacctaaaattaccaaaggctggataatgggtgatatccatttgccagattgcattggtgagtagacctgtatggttaactcttgatctgccaggggcccacaatggtgcaagaggtagacacattccagaggaacttgcaagatatttatagtgttatataagcaattctgaaaagagcttatgtaaattgtgagaggaaagtttaaattgatggtttaaattaatattagggcttgttctagcaattctatgtatacagcccattctgccataacacaggtaagacccctcatgggaatacagaatcatggcctgaagggggttccttggatcatgcctttctagtgttgataaagaaagaagcatcataactttctatagaaggttgctagcttcagatgttagtttaaccctgatagaggggctaataggcccctccaagaaagtaaagacatgcctcatatccttgtccaaaatagataggaaaggttttagccagttaatagttccacataattgttatagttctaaaagggagtaggattttttaccatggtggataaagccaggggcttaatcttgtcagaattagaaaagctcaggaaggcatatggaagcactctctgaatcttttcaggagcaatcttcaagttgaatttttccaagttaagcaacaattgagagaatatctctactgactagttttgtgtaaacttgacacagctggagttatcacagagaaatcagcttcagttgaggaaatgcctccatgagatacaactgtaaggtattttctcagttagtaatcaagggggaaaggccccttgtgagtgggaccatctctggactgagttctatatgagttctataagtcttgagttctataagagagcaggctgagcaagccaggggaagcaagccagtaaagaacatccctccatggcctcagtatcagcccctgattcctgagctgtttgagtttcagtcctggcttcgttggtgataaacagcagtatggaattgtaagctgaataaaccctttcctccccaacttgcttcttggtcatgttgtttgtgcaggaacacaaaccctgactaagacaatactttttcaagatctggtaggctaaggtatgcaagcataatatcatccatgaaatggactgcaaagacatctctggggactcctgtatggctttagtctgacaaattgctggactattttcacacctgtggcagaactgctcactgacatattttatctggttagttcatattaggctctcagctattctgaagaaaaatggcatgtattctgggaaactagagggatttggataatagcaatccttaatatctaagttcatggtacttgggtggaatagcacaagggagaggcaggcccacttgagtgttcatcactttttccatatgttctttaacaactctcagatcctggagaagcctatatttccctcatttcttctgaatgacaaaaaatatttattattattattatacaaagtattatgtatgcttctcaaggattccaaatgactcaaagataattgttccaagactagttccttggaaacaaaaagcctaggttccaaaatgggccactgatccacccagatgtcagcttcacactgccaggccaaaagtataatgtcaggtaccttgatgtcaattggtgttgggtggacagtcatcattatatttgggttgaaatcactgactttgtgacctgtgcagtccagttggtcatgttgcataacatcgtcaaaaaaaaaaaaaccctagtaagtatggcatccctgtgttctagaatatctttttcccaaagtttgtggggaacatcagccacaacaggtgtcaaagattcctgatttctgttcaagtactgcctacagacaggtcaggtagtcattttggtggcttgctagcttacaaattctgtattgaagggaccaggccagaatctccaatgggggaaccttattgcttaatttttacatttatagtgacatctgcccatgtgtcaagtatccctttaacgggtataccatctaaatgtacagtaatcatcagggtgtatagaaatagcaagttccaaaggactactggccaagcagggctcactcttactggcatggctgaggggtgaactttttgaagtttaaattgtcttcctgcttttgggagagcttagccagtgtaaatttaagctttgacaagggtcagtttgctctcatgttcaataccatactaagcataggaaggacagtattttgtgattgtgttacctcactcaggatgatatcctctagttccacgcatttgcctaagaatctcataaatttatttttttcaatagctgagtagtactccattgtgtaaatgtgccacattttctgtatcctttcctctgttgaggaaacatctgggttttttccagcttctggctattataaataaggctgatatgaacatagtggagtatgtgcccttattaaatgttggaacatcttctgggtatatgcccaggagaggttttgctggtcatcattgggaagagaggatcttggtcttacaactattatatgcgccagttctggtaataccaggtccaggaggcaggaatgggtgggttgggaagcggtgggaggagggtatagggcacttttgggatagcatctgaaatgtaaatgaaaaaatatctaataataataaaaagatcatcttttttaaaaagatggtattaataagttctaagccaaaaaacaacaagagaaatattttttatcaagtttaattgattaatgctttgaaggtcacaatattatctggagaaaccaatctgatcacaaaattgttattctttttttttcatttattattaggtatttagctcatttacatttccaatgctataccaaaagtcccccatacccacccacccccaatcccctacccacccactccccctttttggccctggcgttcccctgtactggggcatataaagtttgcgtgtccaatgggcctctctttccagtgatggccgactaggccatcttttgatagatatgtagctagagtcaagagctccggggtactggttagttcataatgttgttccacctatagggttgcagatccctttagctccttggctactttctctagctcctccattgggagccctgtgatccatccattagctgactgtgagcatccacttctgtgtttgctaggccccggcatagtctcacaagagacagctacatctgggtcctttcgataaaatcttgctagtgtatgcaatggtgtcagcgtttggatgctgattatggggtggatccctggatatggaagtctctacatggaccatcctttcatctcagctccaaactttgtctctgtaactccttccatgggtgttttgttcccacttctaaggaggggcataatgtccacacttcagtcttcatttttcttgagtttcgtgtgtttaggaaattgtatcttatatcttgggtatcctaggtttggggctaatatccacttatcagtgagtacatattgtgtgagttcctttgtgaatgtgttactgcactcaggatgatgccctccaggtccatccatttgcctaggaatttcataaattcattctttttaatagctgagtagtactccattgtgtagatgtaccacattttctgtatccattcctctgttgaggggcatctgggttctttctagcttctggctattataaataaggatgctatgaacatagtggagcatgtgtccttcttaccagttggggcatcttctggatatatgcccaggagaggtattgctggatcctccggtagtactatgtccaatttcctgaggaaccgccagactgatttccagagtggttgtaccagcctgcaatcccaccaatggaggagtgttcctctttgtccacatccacgccagcatctgctgtcacctgaatttttgatcttagccattctgactggtgtgaggtggaatctcagggttgttttgatttgcatttccctgatgattaaggatgttgaacattttttcaggtgcttctctgccattcggtattcctcaggtgagaattctttgttcagttctgagccccattttttaatggtgttatttgattttctgaagtccaccttcttgagttctttatatatgttggatattagtcccctatctgatttaggataggtaacgatcctttcccaatctgttggtggtctttttgtcttattgacggtgtcttttgccttgcagaaactttggagtttcattaggtcccatttgtcaattctcgatcttacagcacaagccattgttgttctgttcaggaatttttcccctgtgcccatatcttcaaggctttttcccactttctcctctataagtttcagtgtctctggttttatgtgaagttccttgatccacttagatttgaccttagtacaaggagataagtatggattgattctcattcttctacatgataacaaccagttgtgccagcaccaattgttgaaaatggtgtctttcttccactggatggttttagctcccttgtgaagatcaagtgaccataggtgtgtgggtccatttctgggtcttcaattctattccattggtctactggtctgtctctataccagtaccatgcagtttttatcacaattgctctgtagtacagctttaggtcaggcatggtgattccaccagaggttcttttatccttgagaagactttttgctatcctaggttttttgttattccagatgaatttgcaaattgctccttctaattcgttgaagaattgagttggaattttgatggggattgcattgaatctgtagattacttttggcaagataaacatttttacaaagttgatccttccaatccatgagcatgggagatctttccatcttctgagatcttctttaatttctttcttcagagatttgaagtttttatcatatagatctttcacttccttaggtagagtcacgccaagatattttatattatttgtgactactgagaaggatgttgtttccctaatttctttctcagcctgtttattctttgtatagagaaaggccattgacttgtttgagtttattttatatccagctacttcaccgaagctgtttatcaggtttaggagttctctggtggaatttttagggccacttatatatactatcatatcatctgcaaaaagtgatattttgacttcttcctttctaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggtatgggccttgaattcctgatctttccaacacttttatcatgaatgggtgttggatcttgtcaaatgttttttctgcatctaacgagatgatcttgtagtttttgtctttgagtttgtttatataatgcattacattgatggattttcgtatattaaaccatccctgcatccctggaataaaacctacttggtcaggatggatgattgctttaatgtgttcttggattcggttagcgagaattttattgaggatttttgcatcgatattcataagagaaattggtctgaagttctctatctttgtggggtctttttgtggtttaggtatcagagtaatagtggcttcataaaatgagttgggtagagtaacttctacttctattttgtgaaatagtttgtgcagaactggaattagatcttctttgaaggtctgatagaactctgcactaaacccgtctggtcctgggctttttttggctgggagactattgataactgcttctatttctttaggtgacatgggactgtttacatggtcaacttgatcctgattcaactttggtacctggtatctgtccagaaatttgtccatttcgtccaggttttccagttttgttgagtatagccttttgtagaaggatctgatggtgttttggatttcttcaggatctgttgttatgtctcccttttcatttctgattttgttaattaggattttgtccctgtgccctttagtgagtctagctaagggtttatctatattgttgattttttcaaagaaccaactcctcgtttggttaattctttgaatagttcttcttgtttccacttggttgatttcaaccctgagtttgattatttcctgccatctactcctcttggatgaatttgcttcctttttttctagagcttttagatgtgttgtcaagctgctagtatgtgctctctcccatttcttcttggaggcactcagagctatgagtttccctcttagaaatgatttcattgtgtcccaaaggtttgggtacgttgtggcttcattttcattaaactctaaaaagtctttaatttctttctttattccttccttgaccaaggtatcattgagaagagtgttgttcagttttcatgtgaatgttggctttccattatttatgttgttattgaagatcagtcttaggccatggtggtctgataggatacatgggacaatttcaatagttttgtatctgttgaggcctgttttgtgaccaattatatggtcaattttggagaaggtcccgtgaggtgctgagaagaaggtatatccttttgttttaggataaaatgttctgtagatatctgtcaggtccatttgtttcataacttctgttagtttcactgtgtccctgtttagtttctgtttccagatctgtccattgatgaaagtggtgtgttgaagtctcccactattattgtgtgaggtgcaaagtgtgctttgagctttactaaagtttctttaatgaatgtggctgcccttgcacttggagcgtagatattcagaattgaaagttcctcttggaggattttacctttgatgagtatgaagtgtccctccttgtcttttttaataactttgggttggaagtcgattttatccgatattaaaatggctactccagcttgtttcttcagaccatttgcttggaaaattgttttccagcctttcactctgaggtattgtctgtctttttccctgagatggctttcctgtaagcagcagaatgttgggtcctgtttgtgtagccagtctgttagtctatgtctttttattggggagttgagaccattgatattaagagatattaaggaaaagtagttgttgcttcctgttgtttttgttgttaaagttggcattctgttcttgtggctgtcttcttttagttttgttgagggattatcttcttgtattttctagggcgtggttcccgtccttgtattggtttttttctgttattatcctttgaagggctggattcgtggagagataatgggtgaatttagttttgtcgtggaatactttggtttctccatctatggtaattgagagtttggctgggtatagtagcctgggctggaatttgtgttctcttagtgtctgtataacatctgcccaggctcttctggctttcatagtctctggtgaaaaatctggtgtaattctgataggcttgcctttatatgttacttgacctttttcccttactgcttttagtattctatctttatttagtgtatttgttgttctgattattatgtgtcgggaggaatttcttttctggtccagtctatttggagttctgtaggcttcttgtatgttcatgggcatctctttctttagatttgggaagttttcttcaataatcttgttgaagatgtttgctggtcctttgagttgaaaatcttcattctcatccactcctattatccgtaggttcggtcttctcattgtgtcctggatttcctggatgttttgagttaggatctttttgcattttccattttctttgattgttgtgccgatgttctctatggaatcttctgcacctgagattctctcttccatttcttgtattctgttgctgatgcttgcatctatggttccagatttctttcctagtgtttctatctccactgttgcctcactttgggttttctttattgtgtctacttcactttttaggtcttggatggttttattcaattccatcacctgtttggttgtgttttcctgcaattctttaagggatttttgtgtttcctctttaatgtcttctacctgtttggttatgttttcctgtaattctttaagggatttttgtgtttcctctttaatgtcttctacttgtttagcagtgttctcctgtatttctttaagtgagttatttaagtccttcttgatgtcctctaccatcatcatgagatatgcttttaaatccaggtctagcttttcaggtgtgttggggtgccctggactgggcgaagtgggagtgctgggttctgatgatggtgagtagtcctggtttctgttagtaagattcttacgtttacctttcgccatctggtaatctctggagttagttgttatagttgtctctgtttagagattgttcctctggtgattttgttacactatatcagcagaccagggagactagctctcttccctgagtttcagtggtcagagcagtctctgcaggcaagctctcctctttcagggaggtgcacagttatctggtgtttggacctcctcctggccaaagatgaaggcccaaaacaggatttttcccagaagctgtgttgctttggcctgcagactgcccgctgcggagtcccagaatcaaggtggcccccgcggaacgtgaggcataagccttacaggctgtgcggacacctgtgctctgaccaggaaggtggcaggttgtctggagccgaaaatggcgccgcctcagaggctctgtggctctagcccgttccagaagctgctggcctctgtgttccacactctcacccgcagaccgccggccgcggggtctccgaaccaaggtgacccccgaggaacgtgaggcagaagcctccagggctgtgcggacacctgtgctctcaccaggaaggtggccggttgtctggaggcggaaatggcgccgcctcagaggctctaaaattgttattctttaggaatggacggtggccaataaatgtatttctgttaagtcaaaaaccaatggagtaggcacaatcaattctaaatgacaaggactacttttcagaggtggaagttggtcactttgctgaataaggcaaatggtaactccaggttagaatatgattttttcaatgcaatggtctattatattgacaggatgtagaacagtgtgatcatccacaggatgaaaaagatacgcatgacaaccttctctcctcacatattcagctgcatagatacaaatacaggttcaccagagtagaatgcaagttgatcaatattttctgagtctatgcacttatttcatctttcctcctgctttgtcaatttgagtatatcttcatcatcacgcagactacatactttattcatcccagcaaaattaatatcaaacaaatctttccatgttcttgagcactaaagctgctattgtgagaaagcacttgtccatctttctctttgacctggtggatcaggctgagactcagaaatgttgggcattttccccacacactaccaacacccaagcatgaagcagaggaattgtttctcatccatctcaattttaccctagcacaaatgctttacttttttttctgatgggtttattatatggaccttgatataaccattctcatgtatacacatgcatatcatatcacctctctgttcacacaaacacactcagtgattattttactccccacaactattctttctgctttgacattgactgctcctgaatttttatttgaactgtttaatcctatgctttccccttgaacatggggattatctgtgtcaataaagggtagcaagaaagaggagatgtaactgccctttttccatttttgaaaatccattccatgaaaaaaatctgcgtgataaattggcctcattctgtaaccttaagcttataaatgcttacatcaatatggtgtgttgacaatacctttgctatttctaggatcatagacatttatcactatgagcatccactgctgccatctgacttatacctgtgcaaaatctgtgtattatgacagtctctgtgaattcaaatgtggatcagtttttgttgtattttgaagtatttgcttcccaggtgttttctattctcattggatattatttcttttctatctccttttctacaaaattccctgatgactcaaggcaggtattaaatggaggtattgtattaaggattgagtggtccaagttttctaactctctgtacactgtccagatgtgagtccatgtattcatcctcatctacaacaggagttagcttctctgaaaatagccaagcaactctttcatcaatgtatatagaagaatgtcactaggagtcattttatagttgtttccttggtatagtaataacatttgatttttccatagatttattatatctaaaatccatatatccacagttaacaatattggaaattattgatgacatgagagaaaacttattcacagagttggatatgagtaaaaattctcattagtagcatatacactagcattcagtgcttcacctggagtgaaaaaaatattaccagtcttttagtattgctgtgaagacttacatcctaaaagatcttgtaaatctcaagccacattcagcatacatcttgttttatgagtgtatttttcagttaattatttaacattgagaaacattctaaagcctaaacgtatcctcccatttctgtaaaaagaactactgtataaatgtacagatctcacaattaaatggtgttactgataaagtgtttttctttttgtgatcttgaggtatgaactccctcttctgcccaagaacttaggacgtgctcctcgcctatttaataagaagattacagagacacacagaagaataactagacagtaataatttagaaaaaggtgcttgcttcctttcttggttgcttgcttactttcagctttccttattaatttcttttgtgtttgttatattcactttttattgtttcatttcattgcatattcattggctatatttttaaatctagatattttgtgaatatcttttctttcaggagaaatgcaatatttcttaaactagatgttattaatctttcttgccacagaggaaaactatatatttcattttcctaatgtattgtcctgaggacaatatctagtaagtgttcaaagatctgaaatcagcttgtgtccctttaattctaaccttaaaaaagtaccaagaatgtcaggtattttcttccatagatattaatgaaatccctcttacgtacataacataatttgctgtgtgtttcccccatggctgcatgtttttaataaaaatgatagtttcatataattatataggtatctgtaaagtaactttcaccacattctacatcattactactcttttttctacttaaaccatatattctaaatcctcttactactttattttctttttgaatgaatttttgacaattttttaaaaattattctacaataatactaaatttacctaatttctatacttcaattctgtatattctgcactcctctttaaaagtcattaactcctctttaaaaattattgttacatgtgaacacacataaaacatgtatacatttgattatggacacaaatatacagtgggtggaacctaggatatagaactaataaactaggcatgtgaatgttccagactgcagcagtttatactctgagggttaacaagtgttacaggagtaagtgctcatgaattcaagctgtatacaacacaaggataagctacatgtggcaaaaacatgttttaaaaaggcatgtgggtagtttaaacgtttaattaaatactgacagcaaggaaaaaaaaagagaaatctcagtaaatacactactctgcactacacctatgacgagcatgaaaacatattctacagttctgtcttctgaagaaatgtaattcgcaaaactcatgatttgttttttattgtaatattctgttctatttttctttatcctggcctattctcatgagcattaagaattctgctaaatctctccatttcttgatcctcttccccacctttttaaacattgaaaaaatgattaatttttaggaaatatgcataaatacaccatgaaattagattcttatcatttactcactgtgatgccgtacaaaatattgtgtaaaagctacgtttaatccgtatttcataaaggaaactattccaggcagtcaagtgactaagtaaggtaagacagtgacaaggacatagctagtttgttctaccatttaactcaagcacaacctgggaatcagcacaagttcagggagagccttaaaatatgataaaaactttgatttttttcttgatttctttcttttttatttattctctttgcactcccattactgcttctcttccataatcactcctccaggccccctccctttctcttttaagagggtggagtccttcacttggtatccacccacctcagcacatcaagtctgtgccagtctagaggcacatctactctgccttaggccagacaagataacccagatagtagaacatatcccccacaggaaacagcttttgggatagccacaagtccagttgttcaggacccacatgacaacctatttgcacatctgctacatattatcagaggggaggggaaatgctaggtccagcccatgtatgttctttggttgttggttcagtctctgagagctacagtgttcatgttagatgatgccactatctggttaattaaaactttccattaacatttacttgtttttaagtagacttctcttgtagatacctcaaaacacctccaaatcctgtaatactatattgcactagccttatgcttgacagtttttttatttttatatgatttaacaagggcttatacttaggtcttcatgtgaaaaatggccaatatatgaactgagccatacctatagctcatttgacttttttttacattttaataatatatgtataaagtcataattttctgtccttatcagctgtttgactagtttcattatcaaaccatcatgtaaaattgtggggaaaataatttaaaatgcatgtttatcatagtttgcattaattattcaaatatttcacttattaaccagggaattaatcctgaatgctcatgagtagcacctaaagagcaaccacatgaacttggaaggggacactttctgctgattcctgagttctgatttcaccctcagacctgatctacatctgcttgtttgactagaagactgtaagtaaaggcataacacagatagcatgatgtattcattggtttgatgttgacaacaatccataaaaataataacactagaaaaaatataaaaataaatggataattattttattagtattttgaggagagtactcactgcaatttgcacaaccacatgcactatattattcagggttctctataggaaacttgacctttcatattgcagcctgagaaattttttacattgtgtcaatagcaaaggaacatataattactcctatatagttcaagttttctcttcctttcattttatcatgttttgtattattcaaagtttataccaaaggtgtgtatatatatatatatatatatatatatatatatatatatatatatatatagtgttcatgttagatgatgccactagctggttaataaaaaactttccattggcttttacttgtttttaagtagatttctcttgtacatacctcaaaacacctccaaatcctgtaatactatattgcacacacacacacacacacacacacacacacaaacacacatatatcttgtatatcatgataacaacctcaacaccccaacctagcatttttattttttaatgttgaattaatcatgttgtctcacatatgctaagccaccactctttaatgagtgtatatgtgcaaccacttcctaatctgtcctagagtcacggtccatattacttttcctcaaaagtcaagctaacctttatatgtttgtatgctttaaactccctgtgtttaattattgctttctatatgtacattggttttgggtcatttatttttacattagcatcctactgcagttgcatacatccccatgtacatctggttttccctcccttgtacctacccactgtaaatattttcacatgtagcaggaactccatgtaccctcctcttcattgcttgaatgtttccttacttgattttaatcacctccggtttggtaactaatttttctgttttgtttaatagccatgtcaaaaaatcaatattttctacatctctttgacattttcctgttcatctattcttcccatgtttatgttcatactttttctccctctcttctgcaagctgatataaatattccagaaatgttaaagtgaagaaaatctgtgtgtgtgtgtgtgtgtgtgtgtgtgtgtgtgtatgtatatgtatatatatattatatatatatatatatatatatatattcatccatatgacattattgcatgggggaatctaagtccttaatttgtttttaggaaaaaataagactcagcactgatatctccacaagaataatacaggacatttgagaactgattgttttttcaaaatatctaatccaaaggtcaattatcagaatgctagactttagactatttcatctctaactactactaaaaaatcttgttaatatggctttattcaaaactcaaactttattcactctaaaagaataaactaaacaatattccagataacagcatcctctaagatacatttcttcctttttttgtaaactgtcatccaggattttatgcctgtttgacaattgtggagaaagttttgatatagtcatcattatcatgtcatttctatacccctttatgagtgagaggcgtgatatcactaactagtaaacgtgaaacatcagttaattttataattctagtaatagcaaggagagtagcaggattctgctctaataaagcagtaagcttttaccttgctgtgtgggttgtttttatatataatccacagataaagcatatgcctattaattggagctcaataatccattcgttttctggtgttgttggaagattttccagtaatagaagaatttaaagagggattacatgataggataaacagagaaagagctactgaagtattggaatttaattgtcaaaatatgtcagtttagatttagttcatttaaaaaatgaaattataggaaaaccaatttctgcactaatgaaattgtggaagtctctgaagattttcaagaagttcacaagggcatccacggaaagtcaagtaaatgaaaccaagtctacctgataagggcaattatccatttttcatgatacttttcctcataaacataaactgtctaataggatataccttcctaattaaagttcaatatatcaccatgacttcactacttcaacttttgaacatttgggaattgttcatataatagtcatataaaggagtaatcttcagaagatatgccttatcttgttgggcatctaactggggaagaaagtgataatggtagtcccaatgaccattaggattaagtgttttcttgaactatgtgtagactttgcaaggactctcttcataagtacaataatcactccacacctctggagttattgaactgtataaacctccctagatataagatgaggggtgatgtttaaattacaaacatagtgtaatgaacaggatagcagcagaggccatatacatcatttcagacattagtggaatcaattcagatactgatggagaggataattgaggaaatcaaaatgacataagtggaaagattctgggagattgagtaaagttgatgaacacaaacagtgttagtgtctcatgtgcattctgatatatacaacattaatatatgtgttaaagaccaactatgacactgtagggaaaactgaggaagactgcaagtggcgatggcaggggttggtggtaagagcagctgaagaatgttggtccggatacaaacaggagctgctgcctatggcaagcagtgataagacagggtgtgaggggagaagaacaaatatacacacacaagcaaacacacagaaggttgaaacaagggatgtgcttcaacaatttacttttttccctcaacagttatttagatcgcttaagaaaaggttttcttttcttttttattttttattaggtgttttgctcatttacatttccaatgctatcccaaaagtcccccataacctccccccccccactcccctacccgctcactcccactttttggccctggcattcccctgtactggagcatataaagtttgcatgtccaatgggcctctctttccagtgatggccgactaggccatcttttgatacatatgcagctagagtcaagagctccggggtactggttagttcagaatgttgttccacctatagggttgcagatccctttagctccttgactactttctctagctcctccattgggagccctgtgatccatccaaaagctgactgtgagcatccacttctgtgtttgctaggccccagcatagtctcacaagagtcagctatatctgggtcctttcagcaaaaccttgttagagtatgaaggcaaagatgcagtaattagtggaaaatctgtaacttctgggtatatttgaacttttcactctttgatcttagtatttcagaaagtagaaatagtactgagactagtagaagatgatgtgcactcacacacacacagaaacacacacacacacagagacagagagagagaggagagagagagagagagagagagagagagagagagagagagagagagagagaggagagagagagagagagaaagagaaagaaagagagagagaggagagagagagaggagcaagagagagagagagagaaagagagagacccttaggaataggcagtaattgtataaacttagactaatgattgacagtagtacttatctgcagtccacgtccgtatgtcctgtaacaggtcgaacaactcacaattcacggaatttttttccttatgttgttttatttattacacaacatttacagtaatgcattctattaattaattatatagcctaatcaccattcacctcccggtctgccctccaacccctccccatcttcctttactcccctgtctcaaataggatgtcaccatcccctcaccccaccccacccgaccaaacctcagcataaaactatttttttttataatttagcattactacaattcataacatgtacttaaattctcattgtaaaagtttagttgggtgcgggaaggggggttggagacagggaatggaggggagttataggatattgaggagtcgcagggtggactagaggggaataaaatctggagtgtaaaaaatagataaataaaagaaaaaagtaagctaacaattgtctataaattgctggaattggctaatgacttgagtaataacaaaggtttttgaaccattctttcttctatccaaaaagttggaataggtttaagtttctaaacccagaagatctgagagattgtcctgtcttaaaaaacaaaaacaaaaccaaaaaccaaaaaccaaaaaccaaaaaccaaaaaccaaaacaaaacaaaacaaaacaaaacaaaacaaaacaaaacaaagcaaaacaaaacactgagagactggaccaccattgtgaggcaaacaggatgtaaaggaaaaggacaattttgtctaatagttaccagtaccacaataccggtggcatcctctttggaaatgttcatagaactgctgcaaggaactggaattgttgacaattaaagagtcttatttttggatgttttattttggcttttttttttcattagacactttactgtaatacttaacagatctctggtatttccaaagagttttgagggccaccaattaagtatacctcatttcaaacaaactttgcttgttttagttttttggttgagattaaatcttgaaagcatctacagaagttgaaataaagcttttcccaattagtaaattacttatgtaactgttataactgaaagcatagttctaagaacactaacaaatttagtcttttataaggtacctgaccaataagtgtcttgacttaattctatttaccagtttattctttggactttaaaaaattagaattttacagctttcacattattaagttttaaacttaaattatgatttggagattgaaaatcaaaaataaaatattaaaccctaagtagggtccacacggtgtgtagaatatttattttattgatttttttatagtacacatttacaggttatcacagatttttttgtataaatcagtttcttcaaatagctgtaacttaaacaaagttagcaaaggcaacgtgttacacatacatcttgaagtcagtttgcactagcctgactagaacttataacaatttatcaaacatgtccatttatccaacttatgatattccttctctaaaattttacaagtttctcttccaccaagtcgtttcctttcatctgcacctaacaatgttttattttccttttataaatgatattcaaagatattctcttgttcttaccctctccttcagctctttttgtgtttgtggaatatggaatgggtatcctataatttctggctaagatccacttctcagtgagtatacactatgcatattcttttgcatccaggtgacctctgttagtatgaaattttcaagttccatctatctgcctgaaaaattcatgatgtctttttttaaatagcttagagtattctattatgtaaattaaccgtattttgcgtaactattcttcaggtgaggggactctggtttgtttctagtttgtggaaattatgaatgaaagaactattagtatattggagcaagtattattgtgctacagtgcagcatcttttgtgtatatgctcagggggattatagttagatcgtctggtagaactatatccatttcttttaaagaaaccaccagattgttatccacagtggttgtagatatgagtaatcaaccaaggacatcaagctctctccttcaaggaaatatgaaggaaatttaaaaaaaaggagtcagataaacataaaatcctgtagcattacagacaggacaccatcagtacttagccaatttaaattaaataataatttctactggacaatacacaggctgtattcaggaaacatgttaaaaaatacttgaaagctgtggaattgtgcctcttgtatataaatactatccagatattcaccattttttgatggtgttacaccaatagcaaaattcaatatttattgactgaatagatggacatgttgtttttaggtaagtcatgcctctgtaaatgtaacactgctattttacatattcttgatgatagtcacttctggcatgatttgaaaatacatcactccattttctgagatgtctttctacgggctatgatttctctgtttctttcttaatggctgttcttttttcttttttctttcttttttttttttgtcattgtgttactatgtttattagtgattagaaatgggataacatggggaaaattgtggctcaaggaatattatgaatataccagttgcaatgtcttgtctttctagggtcatttcagcatagtagatgcaggaatctatcacctgcatgatagttttcatccaccaatctgctagccaccggaaaatatttctctaacaagctgtctccttttatttatgaataactttacctgttggtatatatatcatttttttctttgtgttcttctaagcatcagggcttgatcaaatttgaatgacaagcaaattaaaggatagtctcatgtatgtaaagtgagtttgagtggactctggcagctcagatggaaagtactgcgtcttttgggaacttttgtaaatttccttaactcaactggaccaaggaaccagattattgtataaagctatttattgtatataacaagaaggcaggattatggtatataaaagggtatgcatgctcatatactctaagaatatctctgtattgcagcatatcccaactgcatacatctaatgagatgaaacctgtggccaattgtttctatgcacactgtcaacatccccatggatgttgcaataccacctagccttacatgggaaaagaattataaatacagtggatcagtttaatggattattttacattgccatggccagaaacaacaagaatcatacttgtataatttaataatctcacacagaatttctatttacttcttgttgtttttgtggtaagataaacatgagtgctcatacatacatatattaacatggcttttaagggtataagaccctaacagctgtcatcctatactcaatttattaattctataattttttaaatttctgatttaaatgcagtatattattttggatacaccaactgtgaattaaaacataaacaaactcttaattctaccactttgagaggctaacagtcttcagtgagccaccagccctcaacagaactgaattactgatgggaatatcattcaggtcataaaactcaacaagtatacagcaccacctgttaaaaaaaaagaacatgtaatctttcaaagtgtttcaaagctctggaaaaggctctaaatatattaactgtgttttgtttgtttggtttggtttgtactgttttgttttattttgttttgtttttgtttttctgcatatttagttctggctgctcctgataaatatatcaaccgagctacaggtgatgtgttgaaaaatctcatcctgggaaaagatacagagcacagaatgtagttactggctcattaataaaaatgtttccattgccttaatcttgtgtttcagtagacttctcttgtagacacctcactacacctccgaatcctataaaactatatttcgctagccctatgcttgacagatttttatatttatatgatttaaccagggattgtacctaggtcttcgtgtgcagagtggctaatatatgaactgagccctccctatagcctcattttatttttcttacattttttaatatatgtattaagtcataaatttctgttcttatcagttgtttgactagttttgttatcaaagccatctaaaattgtctggaaaataatttaacatgcatggttattataatagtctgcattaattattaaaatattttccagttttgttgagtataactttttgtagaaggatctgattgtgttttgggttttctcaggatctgttgtcatgtctcccatttcctttctgattttgttaattaggatgctatccctgtgccctctagtgactctggctagggatttatctatcttgttgattttctcaaagaaccagctgctggtttggttaattctttgagaaaattcaaataaacaaaggtaaaatgatattaaaggaatggagtaacaataagggggcctggtggctactctagcagttcagacaggactgtgtgcaccagggacattgggacacaggtgaagctttagtgatttggggatttctgatttctgatataaactgtgaattaggtgaagtttggggataagttagtgatcttgataagcatatgaaattatttcttaagttattaaatttttttttagttcttagctgcctgaactacctgtatttcatggagagagcatcagtgccgtggctgttatgagtagttacctgttgtacatgtttttaaaaaagtaactttaatctcttttttgattgtttgtttaggttttttgttgttgttgttgttgttgctttgttttgtttttgtttttgtttttttacagttcagtcattttcccctttttggttcatcctctgacagttccggatcccatccctactcctgtttctccaagaagataccccatcatatcctggcaggacttgccacctcctggagcctcaatgtttgatgcctcttcactcactgaggccagaccagacagttccctgtctaaaaaggagacaccttagataaaatgccaaacactggggaggggagacttgtagactccacttccagtagaaagataatgcctcaagtggagggatggggttgccattccacagtcaaaaactctgacccagaattgttcctatctaaaagaactgcaggggcaaacatggaaaaaagactgagagaaaggaggtccagtgaccagcataatttgggatacatctcaaggggctccaagacctgacactattactaatgctgttgtgttgcttacagataggagcagtcctctgagaggcacaacaagcagctgaccaagacagaagcagaaactttcactcatccaatggagagaagcttgttaaccctgtggttgaattagtgaaaggctggagaatttgtggaggaaggtgatttcactgaaaaacttgtaatctcaactaacctggacacctgcaatctctcagattctgaaccaccatccaagcagcatgcactagcaggtatgaggcccctgacacataaacagcagggaccataaccttatatctggtgttctgtgtcatagagaaaaaaattcatgtgctcatatctaaaggtaagaatattacttaatgagcaatatatccagcctacatattttgatattataccaaaaaataccaagtgtatataatccaacatccatacttataaacaatttgtagagccctacaatttctcacaactccagctataaagctctcctaagagttgcttcttaaatttaaatattatttttctgaatactggatttaaattttgaaaaatgggaaaaaaatctgtgatgtttttctgtaagttctacacatatagtggaacaagataaacacaaggagcacatattcaggatcacacacataaagcaagcttctgccaaagattccacatagacatacagtaattctactttccagagcgtgacaaatgtctgttaaggagaagtgatttgtatgaacaggttcctttatgcgcaggtttatctgcatcattacattgtgtttttcatacatattactcatgaattacaatattttgaaagtaggtatttcatatcataaatattgtacaccttactacctacaaataaagcctgttaagagtagtgattatatcacttaccctctccattatcttccattactttctaatccatgtaactgtaaaacagccacactctcatgtctcttacttcctttccttcatctttgtatttttcttcaccaatatagattaatatagtaaatatatatatatagtgagtatattaatataataatatatagtaatatataatatagtatacataaataatactatgtagtactataaagtaacaaatacttaatatagtaatacagtaaaataatacctccatttcactctattttttacctaaactatccagcgaataagaggttaatgtagagaaaattggctgcacattattactgcaatatttcttgaaacaaataagtaatactgaacagccatcttggccatgtgtgtattgcctactatatcacagtgggcacatactctgcatgaacttgccaatctctaacctgctaatgttacttctggatattgaaattttctctaaagcacccacagttttcagggcagttcttaattcaaaaggcaggctgcaatttttcaagcaggaataccaggccaaactctgtaaaagaaaacagcctgcagggtaaattccctcataatcccttaggactcctatatcctgtagatagaggactcagcccagccttagttgcattgttcactacctactgtatagaatatgccactagtgatataacaagaaagctcaataagcaattccacatggagaatagattcacattgtgctttttctcattcaaaatgtctgacatagaatacatgaaatttactgggagtgtgggattatcataaaaactctgcatcacagtgaaaaggtcagcataggaactttggaaatgtcatgaaacactcacccctctggaagggagaggctaattagcatttctgagaccacagggtgggaacagacctgccagtggggacacaatccacaggctgacccttgctcactttcagacaagggaagtccttgtcacctcattccttaagaccaaccagtttaaaaagtgcactattctgcacggtgtgcctagttgctgatgctctgttctgtccctggaaaccatataaaaaacttgctgaaagggtgctgggggttgatgcctttccttcaggtctgggatgaccccagtgcactggaacaataaattcctcttgctttttgcattaatcctggctccaagtggttcactagggagttcccagtgagctaaggctccctggagtcttacaacagtccgcacatattgggtactttcccttacctgaaacatctcctgatatgggatagtgtttgttcatatttcagtaggattcagtaatgttcaaggccaaggaagcttggaaaaatattggggctccatgaaccctgttttatattacataaaccatgtataattactggtttggggaaaccactttcaggggaactgcctgcaatttgagcagatacctctaagtctcctttatggcagatttcataagttgtaactcattttacaatgggttgtttgatgttgacatctattaaatcgtgcattcatgagtaatagcaacaaaagcattggtgcaaaaagacagacactgagtaattcagattctttcagaataagtctctctctttgtcagatagtcacttaatcctgtaaagtgcaaacctaatgggaatgtaaaaaatatatttcacccatgttattatcagtataaatttcttctataccactgcctattgacctgcagtcttaggattcttattggctcaattaaacaccatgacgaaaaacaacttggaaagaaaatcatgtattccattattcagttcatatttaatcctactgataagtgaagggaggaacttgaaagcagaaactgatgcagagaacagtggtggatgttgcctactgactcattcctcatagcctgaccatcgtgatttcttgaaccatccagtgtcacttgttatggagtggtgatgatcacagtaagtaggacacttccacattaaccataatcaaaatactctacagatttgtttacaggccaatgctatggatacactaaggctcttttccagacataccattaagctgacaaaaagcaaaaaagcacacctctcatttctattcttagtaaatttcattcttatatatataccaatcaaagtatctttatttaatatgtaatacctagagtctaggattttcatcacagtgcaattttgaaataaagttgatgcagagaaaatactgtgagttgtatccattttagtatttttaagatttatcctgaggcagttgatgatctatatctttatttaagacattgctgttgatacttaagttatggcaagtgttgtatttcttatatattaacctaacatatgtcctgttttttttttaagatttttcttattgtgttatatgacatacctcatctttaccttacatatttctttcatctttgggagtttagtatttctctagaaatacctgatagtatagaaatctgtgagtctaagaaagtggcaccaataaacacaaaggacctatttgtaatgcctctctgggtcttcatggcaaatgctgtttgctgtgccttacagtccctctggaaaaaaaagaacaacatagaatttagttgtgtttatatgaaaattgactgactaaataagcacactttttgtatgtcaaaagtatatgtgaaatataatgttttgagagggtacctttggtgagtccaggaatgtgcacccctgagaaattaggccttgcagcatatctggtatgaaagggatttattggggaggattgaggagtaagaatatgagcaagggatagatgcagagaagtgcacatgtagataagcagataaaaaggagcagttcagggagggcagataaaaaggggagtagagaaagatcatatgccaggaacagagagagaaacaggagaatatagagagatctaggatggtggggggcccttttgctacacatacctagcacagctggcacacctggcactcctggcacacctagtaggtgctcaggaagctaatgatgtaggcgtctgctatgtccctgagaacaaggcagggaaataggctctatgctaactatatgagcataccaagcctgtgcttccattagttgagtcttttcatatgaatttcaataaatgtgatttttttattttaagtgaatttattttagtattctctttcaaatgaataattcatgattttaccaagtattttaacttcaggtttatatatatatgtatgtatatatatatatatatgtcaattgatttggacattataggttatttaaaatgttattaactacaccgttttaaaaacatttctgcaactccacttataatatctctgcctaaatatgaggagaaaggaggttttagtgaacataaggaaacattttgcttaatatgcaagtaatgtttatggattctttcatttcatagttttctattgtgaaacattttgaaaaatatgttcaaagctgaaatgcaaattacctgcagtctgtttctgtactcatacacttgtcacatttacatttctctttttcctaaatgctacaggcattgtctggagaattttgatgcttttcatagcactagttccatttatatattttcttgtgtatgtgttcttactttaaaattttggtctcttacataattgtatattttacaaagttgttttaaataacagccacattacttacatccatcttggctgatgtcacattaggataaaaaaggtcctatgcttggcatcccactttactaaggttaaagcatccatgccatatctttcaccaccgctatgaagatgatcatatggtacaagccaacttaggcaacactgtaaatcttagagtctgcagaagtggcaagagattgccagaagaccaccagtactttttttggtgcatttctttttactaagtgacaacaaattatgatcaatgaagtatttaggagaaccaatgccaaagtgttgtcaatgagaaccaacatatgaaaagctcaataaagatgagcaaagagtggcaaggtgaaccactgatacaccataattcactgtctattattttatacttatacgctttccaaatctcacatgtactctcaagtgtctagcaaaacatcaaatgctctttattcaggcagtgtccagaaaagctactaaatactttttacaattatatcttctttttttattatatattttctttatttacatttcaagtgttatcccctttcctagtttcccctctaaaactcccaatccactgccccccttccactgctcaccaacctacccattcctatttcctggccccggcattcccctatactggggcagataaccttcactggaccaagagactctctttctgttgataacctattaggctatcctctgctatatatgcaactagagtcatgagtcccaccacatgtttcccttgattggtggtttagtcccagggagctctggaggtacttgttagttcataatgtagttcctcctggggggggggactgcaaaccccttcagcgatttgggtacttttctagctccttcattgaggaccctgtgctccatccaatggttgtctgtgagcatccacttctgaatttgtcaggcactggcagagcctatcaggagacagccatttctggctcctgtcagcaagcacttgttggcatccacaatagtgcctggatttggtggttgtttatgggatagatccccaggtggggcagtttctggatgttcattccttcagtctctgatttgaactttgcctctgtaactccttccatgggtattttgttcccccttctaagaaggatcaaatatccagtttggtattccttcttcttgagttacatttgtttttcaaatagtatcttcttttttatataatataaaaatgagaagattagacaggtcttcttagcttaaaggaatctgtctcaaagatatatgttcaatgatttgcctatggttatcatcaagcttctacagattttttaaagattttattttattttaatgtatatattacactccatattcaattccctgacccatccaccctctcaccgttccacatctcacacctccttcccttccctcctcacctggtcgccacatggatgaccccaccctgaccccacctgacctctaaacactgtggggcctcgagtcactttagggttagggacatcatttctgaatgaacatagaccaggaagtcctctactgtattgtgttcggggcatcatatcagctggtatatggtgctgtttggtgggccagtgtttgagagatcggggaggtccagattaattgagactgctggtcctctacaggatcatccttctcctcagcttctttcagctttccccaattcaacaataggggtcagctgcttctgtccattggtagggagcaaatatctgcatctgactctttcaggtgcttgttggatctttcatagggcagtcttgttaggtccctttttgttagatttccatagtcttaataaaagtgtcaggccttgggacctctgctcgacttggatcccactttagccctgttgatggacattcttttctcggggtgctctccatttccattactgtaattctttcagacagaaacaattatgggtcagaggtgtgactgtgggatggcaacactatccctcacttcatgttctcctatctttctgctggatgtggtctctatacgttccctctccctactgtagggcatttcatctaaagtccttccctttgagtcctgggagtctctcaccttgcaggtctctagtccatttggagggatccccccaacctcctatttcctgaggttgcctgtttacattctttctgcttggccctcagggcttcagttcttttccctcacccaataccagatcatttttacctcaccacccctcccccactccttccatccagtacactttccctcccagtacactttccttccctccctctctacttgtgattgctttcttctctctccagtgggactgaggcatcctgtcttgggcacttcagcttgttgagatgagttctgtgtatcttgggtattctgtactgttttgtttgttacattttttgctaatatccacttattaaataaataccaaaatcttttatagatgtctttgatatatatggtctacaaattcctaagtatattcaatctagcttaaactaactttaatatatatatatatatatatatatatatcaaaccttattgtatttattactaaatttgtgattaaaagtttcttttgatgtaaaggtatcaatgttttattttttttaatttaattttgttttttgtctgcctccaagtcgcccattcccacattgcttcttcccctcctcctccttctcctctgtgcaggtaaggtcctcaactggggtatctcctgcaaccatggcacttcaaatctctgcaaggataggttcttcttctcccatagagtcccggcaagaaatcccagctagtaatacataactcacatacaaagaactgcttttgggataaaccctgttccagttgtccaggacccacatgaatgctaagctacatacatatctgctacatagaagcagggaggcctagatccagcccatgtgtgtactttggttagtggttcagcctctgagagccccagttgatttgacttagtctactgtggagtctctattcatttcagaggccacaatcattccttctattcttccaaaagagcccgcaagctccattcactccttggctgtgggtttctatatttgtctgattcagctactggggagaggtctcagaaaacaacatgatcccgactgcaagcctaacagagtatcattagtagtgttagggattggtgcttacccatggctttggtctcaagttgggctagttgttgtttggcaatccccttagtttcttctccatcccctgtccttacatttcttgtaaagaggataaattttgggttgaaagttctgtgggtcctttggtgtctctattacttcaatgaggttcctgcctggctacaggaggtggcatcttcaggttccatatcctcaaagttattagtcacatgtaaggtgacctgcaatgattcctgggcacttctattatcccaggtctctagcttgtcctctagatgccaccccacccccctacatctccttacttccatcagttgcagatttcctttcattgtcatggccacctcgtcatcttactgtccttctgcttttcctattgatatatatatatatatatatatatatatatatatatatatatatatatatatatatatacatttacttaattttgactctgtagaagactgaaagatgtaccaaactatgagcattacactattataaattgatcaaatactatgaacagagcaataatcatagatactttcaagggtattgtgtttgtctacccacaggtttctggctgtaatagcaataagagttaagtgttaagtgtagaaaactattgagtacatccatgaaattcatgtaacaattttatcatttggcattttttagcagtacagtctctttaatcactgggattcaaagcctagtgtgattgatttctttcctcctctggtggcatagaactgcttccagtgccatgaaagatatccattagggatcaaaattacaggtcaattctatattgatttcccactcttctataacttaagaatgtagtgtgttcagctaaagggcagtttaaccaagaacgttaacaatagcattgcaatgaataggatctccctagaaaacaagccaatacaaagaggtaacacatttctggtattagattttatatttgttagcctgtagtgtccagtaaagaaatggttattctgttatcagttaaccctattgtttaaatattggtatgtgtatatacatattaagaacacttttagagtagtcactttccatatgacttattcaaaatgcctccagtactatttatccttttctatgttccttcttttattctgctcttctattgccctcactgattaatcctcgatgtatcataattttcctttagtcctttataccactcactggttataaagcattctctttctttatatgcatttccatacacctttactagtttcctaatgtatatagttattccaaatacaacacacatatctgaaaaaataatatcagctttacctctgaatcatgttcttctgtgacaaaatttcaataactttaagggaataatagttgaggtgttttgaggtgcacacatatctgtaatttatgtcctcatcttcccaagtacctgagattatagtcctcctgcattaccagggacactgatattctagctttcaaaattgtatgaaatcatcatggaataatgaatggtgggatttttagaaactttaaatttaaggaataacaggaaaaatcatagaacctcttctcttgctaaggcgtgtagccaagagataaacaaacttgtcaagtgtatacgatgtcatagtttaatacctaaaagcaagaactaaaaattaaaaactcctgcaagtgttatgaatgttctgataatttttgttttacacacattcattcacaaacaggtaaatgtaatgtgtttattgaatgacggtcatggaatacataggcgagctttaccttaaaaataataaacaaatttgtaacaaaactatccagtgctttccaattcttttagttattaattagcaaaatagaaaattcggtctgggcatccaaatctaaactcgaaaacctacacgtgtgtgaaaatatagttcagtggtagaacatttgcttatcttaaaaaaaaacaaaaacaaaaacaaaaacaaaaagagccatctttctatctgtaacagtctgcagttcatgtttctttttcttcatatgcttcaatttgtattctatattattatgcaaaatgtacaactgttataagatctaaccgcgaaacagtatttgttaaaaggtgaggtgtgtgttaacttcgttttatattttaagaaattgtaaagtcctaaatagacattaaaataccaaagtaagttttattagaaaatacagtattatactttgtgcataataatttttaccatcgatgatttcattgcttctgcataaattacttcacaaaggagtgatacgtggggtaatcacaaagaaaatttcggtccctgtagttttgccatttttcctctacagcttctcgctgtctgatggagacattccttaaggcgatgttgccttcgtttttacacatcttttaaattatatgcttcctagagaataccaactgttgaaaacccactttcaaactgcttcgtttccacccccaccccccagccccctcccaccgccgccgccgccgccgcagtcgctgcggtcgctgtggccgctttagtctcctctccgcaagaccagccacagcaggaaatgcgtcaaaaacctgcgcagtggatgcgacgagcctgcggaggaaagacaggcttgataacgcagagtagggaaaggctcggggtgaagcaggagagtcggtgggtccgtgggagagcaacttcatagatgcagaggggactgagatgcagggggaaagggaggtttgcggagaggaaacctaggagagggacaacatttgaaatgtaaataaaccaataaaaactttaaaaaaaaaagaagcccaggggaccaaatattctcttctttgagggtttctccgagccacaaacagagatgcactgtcagactgacttaacttcctgttgtcacaggggcactgtgtgattccggattcatcttcagttttcaagttttgataaaatccgaaatcgattagctaatgaattcgcaatcatacgggttttaggagtctcggcattttctactgagctgcttttctgtagctgtagctttataaatgagccctaagtatttgcttttttaaaggaatatactccagcattagccttaaatcagatcagcggggacgggatatggctcaatctgctgtttatttttaaagttaaaatatttacattgaattttcaggaggtttgaaggcttaaaaataaaacgttcagtgtgattttcttaaatacagtgtgaatgtcctacagacgttttgcttttcgttctaacatccagtaattttctaccaatataatctctaaacaggaatgatacatacatccatatatgcatatatgtatgtatatatgtgtgtctgcgtgtgtgtgtgtgtgtatgcttatatatgatatttgcttcagtcacacaatacattttcaagtgtcatgccacgtaatgcatcttcaagtgtttatgccacagaagggtgtgtgtgtgttaattatttagtactctttttaaaactggctacagtgaagctgatgattatgacaggaaaagaaacttcaacatagtcttatggttgggacattaaggttatatcagattacatcagatattcttgatttatttatagctaagaagtgtgtgaaggatcattggatagaaaattgttatgcactaagagagactctggctgaagtaggatcaaagtaataagacttcatttggaaaatggtgcaggagaagaaacacactcagttgtgcatggttgtaatttctccctcccttaaaatgattctagtttaaatacacttttatgtaaaagtgtacagatattcagaaataaggttctagatcataaagaaaattgtattaaagaaagacaattctcacatgatgaagttttgttttttattgaaaatagattaatcattcaatatattctaattacagtttcccctccctcacccctcacagtttctccccatctctcctccctctgcatacacccctttcagtctcttgttagaaaaggaaaggcttctcagagataataacaaaatgtgacaaattttggaaacaatgcctccatagccaaatggaacctagaagtcaaaattctttggagagtctttcctagaaactacaaaatgtgtttggcttagttggagggtaatgagggtgttcagaaaaggaaagtatcacactgagcttaaataagtggctagatttgagaatcaatgctactggggaccagggaaaacaactatgtcccaatcctcataacttatgtcctcatgttaactatgttaatcctcttaacataggctgacagtaatgtcaccctatttgtatgccataacttatcttcatattttgtatgaatcataacactgcttctgaacaagatttagaatttcctaccatgtgtgtgtgaaaatttttcattacgttgatttttatattgctgtctgtcttctatgttatttctttaccctatcaagaatagagtcctaagccaggctgtagtggtgcacacctttaatcccagcacttgggaggcagaggcagttggatttctgggttcaaggccagtctggtctacaaagtgagttccaggacaaccagggctatacagagaaaccctgtcttgaaataaaccaaaaaaaaaaaaaaaaaaagagtcctagagccaagacttttatgatatggttcatatgacaggtttccatggttttgtgtcactgtcatatggtaataaattttcttaacatatctaagtcgaaatattacatttctctagccttttttattattttcatatatggatatccttctatattgtccagaaacatctgtttgtatcagggcattcaatccttttctcctgagcctgaacgttaaaattagtaactagaatggctgtttaaaaattgacttgtcactagaccaatgactcagcagttaagagatataactgtttttccagaggagccaggttcaattttctgcacccacatttcaactcacaagcatctgtctttagtcccaggagatgtgagacactcttttctggcctccataggcactggagacacgccacacagacacattaaagggtaatgccaatatacaaatacataatattttaaaaatctaaaaatacaaagtctttcattgcaattggcctattattaagggaaattgagtctatgccacaaaataatgatttaaaaagttttatcattctacaaattctgatcattctctgtacaatagaacaaaatcaaagatggaatcttctctcttagcttcctgtgcacctggaaaggtggtgaggtggaaatttcagaactaaaatacaacaacaacaacaacaaatagctttagctttttaaaatgataagataaaaaggacaaatcccaggtcatcatcagactcctcagattcttttaacattctttcctctttcttctagtcagctgggttatccctgctggaggggcttggaccacctgctggtgcatttccctgtgctgtggaaagatcacacctcttcatcacacttctagatggggctccatatgtttacaatgagcagagatactacaaacaagccaggccagtaaggcttaatattgaaatcagataatttaatgagactattaatcaattctcttattgcttgtcacatcatagtacatagtgcagttcacaagcaaaatagatgaaggctatatacttcaggctactgatgcaatgctaatcgctggataaaatgattgtcttatgacaaaacaactttatttccactgtaatcactgagcacctgtgtggcttcataagaagggtgttaggaccttctccagcttcctcttcatagctcttctctagggtgtccctatatcattctcccccatgtaagggctccataaaaaatcgccccctacttagttgtatgctgcaaatggcccatctcctttctctgctgtatagtaatctcactcccttcaatatgtccttcctttgagctggtcacatcatgggctgatactgtacaatctgaagataaactggcctaaaacatgggacagctgcccagccatggcccttgctcactcattggtattgccttccctgtagtattccaactaatactttcttcttgggttgattattctgaatgtcccatttcttgattgtaatttcttccagtttattgattgtaaataataaaaagggaatgtgattaaaaagaatgagtagctaaaatcatgcaaattaaagctatgaaagacaaggaaaggattactgatggtattattgtaattaattgtaaataaattgacaattcacaaggagaatatgtgaatttttttatgacaacaggtgtgaacgccatattttttggtgtggttccttttgtcatcacctatgtgcgtgcctacattaaaaaaaaaacctactaaattatagacaaatttggatttcagagaattagaatgttggatgggggaagggaaagagaagctagaagaatatcctgtataagaaaagaatgtttataaaataggaaatagaacaccttcctaagcctaagggaaattgatcataaaaaagaatatacttacagagctcagacttttttttttcttgtttttttttttcttttgcctgcaagtgtctgtaaaaaagatcctaagaaaaaacatccattctctctcgttctgaaagaaaacaattctggttaaagtttaggtttccttgtaacctcaaaagcagttttcagaattccatggctcattgtgttttaggaaatcagtgactgccttgtgcacaccgccatctaccgtccaaaaattgaacatgcctgagaaaaactcatttaaaagtccttgggtgttgttgttgttgttgttttatttgtttacatttcaaatgttgtcccccttctcggtttcccctccacaaaccccttatcccgtcccccatccccctgactctatggagatgcccctcccccaaacacctacccactcccacctctccaacctagcattcccctatgctcccctcttattgatgctagataaggcagtcctctgtaacatcttaggctggagccatggggtccatctatgtgtattctttggttggtggtttagtacctgggagctctagggagtctggttaatttatattgttgttcttcctaaggaaatgcaatcctcttcaactccttcagtcctaactctttccttagagtccccatattcagtctggttgttggctgagagcatttgcatctatatttgtcaggctctggcagagcctctgggggacagctatactaggcttcagtcaacaagtgcttcttggcatcaactgtagtactgggtatggtatttgctgatggaatggatccctaggtggggcagtttctagatggcctttccttccttctctgtttcactcattctctgcattttctttagacaggaacaattctgggttaaaatttttgagataggtaggtgaccacatccctagagaactttatgatttgcatttccttgatgacttaatgtgaaaaacatttctttgagtgcttcttggccatttgagattcctctgtttacaattatctgtttagttatgtattccacttattaattgggctatttggttatctatagtctacttttttggttttttttttatatatattttggatactagacctctatcagatataaggttagtgaagattttcccaatctgtaggctgttgtttaatcatgggctccagagggagggagggaggtacctgggtgtgaaatgcaagggggagggggaaagggggacaggattaggtataggggcagataggagagaggtttaaagacatggaggaatgaatggaaatatgcagatgccaagggtaggggagggggtgaaacactaagaagtcccagagacctgggatggaggaagctcccaggactcagtgggggttgccaaaccaaaatgcccaacactgtggatatggatcctaaagagaccacctccagtagtcagacaggacccccagtggcaggatggacataccaaccgacatgcacaacttttgacgcaaaattgatcctgtctaaaagaagtgcaaggacaaaaacagagcagagattgatggaatagctgaccagtgacctgcccaacttgggttctatcccatgggtaggcaccaatccctgaaactattactgatgtcatgatgttcctgtaaaaaggatcctagtgtggctgtcctctgagaggctctagcagctgctggttgagacagaagcagatgtttgcagccaatcattggactaaggtcaaggacccttgtggaagagttaagggaaggattgaaagaactgaagtggatgcaaccccataggaagataatattgttatttttatgtttccacaaacatgaatcaataagtgtatataagcatgagcatatatacatttcatacattactgtgccatttattcagttgtacttgttttgtgatagttattcttaactgattgtatgtggtatactaccataaatatttttgtcattagctgttctatgattcacaagcctagaagaatttcttaagtcaagcttacatacattttggctgtttgatatatattagatggagtggtctgtttatttagtgaaatcaccatatggtgttcaggcccttgatatgctactgacatcagtttcactagcctccttcagagcgagaaaggaatatttttcagtgttgtttccaatttgctaaaaggtgaatattcttggggatggtacggagaacctaacaccctatagaaagaatgtgtactgtattaggacataatgagaaataaaggagtgtggcatgatgagaaatagagcagtgaccctctcctgttttactttctgtgtttgagtcagtttaaacaagctccaggaagttcaccacaggtctcatatactgatcagtcttttagcaagcagcccaaagcaaaaatctttactaattttttcttcttctcaatatttatctttggtctttattttttctaaatattagattggttagatattttctctttgaagtatggagtatgtggattgtaaaaaactgtaatttctatggaattatttttgtcctttctcttcaatactaaagatttgcatttattcttattattttaatctgaaaactaacaattatatgtagtagtgcatttttgaagctgtattttattttcttttattttatagttctttggcttcctactgattcttttttattttgtagactaccagtgaattaatttagtaggaaatttgtaggttcaatatgagtaaattcttgaaattgtataattttaaacgataatttataatgagtgtttacatgttggagaatgtttgacatttgaagaattaaaaaaaaacagagaatcagagaaaaaaatcacatattcattcaaaaacatggctggggacataaacaaaaggagcattttcaagagaagaaactaaactgaaaagaattgtgtaaaaaatatttgttatcccgagtaagtagggaactgcaatcaaaacaactctgagatttatccctcccaggcagcatcaccaaaattaaaaaaaaacatactgaaagtgtgtggggacaagagaaacttcatttactttttgtaggattccaaacttgtattgccattatgaaaatcaatgtggagaattctatcaagatgaatgtgtatatgtgtgtgtgtgtgtagagtgtatatacatatgctaaaatcactcactatcctcctttataaatgcttgcttagtcacattgctgctctagtcacaaactcaacatagctcgaaaatggaaacaacctaaatatctttcaactgataaatgaaaaatgaatatatggagagagagaaaggaagagagagagagagagaattgtgtatgtgatactgttcatctgtaatgagagctgtgtatgtgatactgttcatctgtagttagaaaggaaattatgttactttacaaagataaatagacctagaaacagtcatattggatgagattccccagaccaagacagacaaatctcacatttcccttattggaggcttctatctcttcctggtcttcagatgtgaatacataccatgaagtaacagaagaaataataaaactaaaatggagttatttctgcggtaggtgattgggaaagcagagagtagagtacatcaggacacaagtcatatgacaggaaaagagaacagggctttaattaggaaaaggaatgtagacaaatacagaaaagcaagtagggggatagaagaaaagtgagggtgtctgggaaaattatttaaaatcatactattaactattttcttaaagtaaggaaagaaggaagaaaagaatgaatgaatgaacaaaaaacaaaggttggaaggaagaagggagggagggaagaaggaaagaaacaactatatcacaggtatgtatgtaaatgtgcatatgtagtatccatgacattttttttatattggctggcagtgttccttctggtaaaatatcacctaataaaagtcccaacagacaagagcagaccaattttgaattattggtcaagcttgcctaattgactccccaaaccaaattatccaagtctactcaagccatgaattttaaaaacataaaatcaccattctactaaaccttcataattccttacttcaatatatagatgtgtctttatacccagttcagagtataggtctgatcaaaaggagagtacatatcagatctgatgagtattattctgtccaaaagcctaaggcatggggatttaagtagctcaatggtacaatgcctgaacagtgtataagtgtttctgggttgaaataccagaatctcagtgaaaattaagtttgtagcacaagcatgagagctcagcctttaaaatgacctcaagccaagcctgtcacgcagagttctatcccagaaaaccttatgccaaagaagagaatttacttccacaagtttctcttggaccaaagaaaacacctactcccataaataaatgaaaatttaatgacttaaattgaaggaacacgaaaccatcagtttatcagtaatcatgctgatttaaaaaaaaaacagacttattttcagacagatttattttctgatcatggttcctcccttatcgtccctcaatttgtctctttgtagaaaatatataggtatattaaaaaacaaaataaagtaaaataaaaagagagaaagcatcaaaatcacagacacacaaagattcatgcctttacacaaaccccataaaatgcaaaatttgaaatcacaataaaaaagcaaattactagtaaagaaattcaaacacagtcagaacattctgagttaactaacaaaatactgtcaaaatagcattgagttcatatgagttagctggataaaacttgtcatgaggattccatctgagtgtggtttatatccccgttgattcaccatcacggtaaactagttttcctttgtgagtagtcatcaactggaggtggctttctggttagaagtgattgattaggtcgacttccttctcttggcactgacttgaatctctgcagatcctgtgtatgctgttctgatctacttgagtcagtcttttatttatgtgtttacatttcaaatgttttccttttttccatttcccctccagaaccaccctatcctatccctctccctgctgcttctaaaacagggatcccactcccacctacccactccaatctcctcaccatcctggtattcttaatgtgcctagaaggcattgtttccatggttacattcctccctgccacactggctattagaatctctgtaactgtcttctgcaaagtttcctaaccatacaatggagtttggatagatataactcatttatgactaggtgatccaatgtctctcattctatgtacattgtccagtctaggtttttttttttcctttttgttcccatctactatagatggcagcttctctgatgaagcactgattgatgggttatgacaaaatgtcattaagaatcattatatttcttcatttcattagaacaagattatttgaccttctcctatgtccattaattacttagttccatatgtttggatacaagaaatatttttgttctcatggagtgggccttaaatccaatcatacaataattgttcaattccacaatatttctgccactattttaccagtgtatcatataggtatgtcatgattgtagatcaaagaggttagaattgggctggtttctaaattaatttccagaaagcatgcaaaatacttcacagtaacatcattcatttctattcgggtggagggaaggtttcaattaggcacatgcttgatttctctgtgttcagtgagacaatgcggacattgttttcctcaatagggacataccatcagtttgtgttggtaatagcctgactcttttgagtgtttccatgaagaatctttgtccaaaaaatcaattatacataactcatacctaggattaaaggtttcatttaatgagaaatgagtagttcagggattctttcccagttagttagttatttgatttatatttttcatctatatatattaacatgatgatccacagttctatttttccatctcagtattccatcccttatttatccccaaatttatcatctctccctattgtcttcatttttatatatgctatttctacttccacttgaaatccttcactcccttcaattatcttttgctataccttacctttgtaaatttaaggattcataatgcttttgagaaacttaaaacttaatatttaactatgagggaatatattcacatttgtctttaggtttctgggtacctcactcaggatgacttttcttcaatttctatccatttacctgtgagttccataattttactttttttaacagctgacttatattccattctataaatgtaccacaatctcattattcattcactactttttaagacatctagtatgttttctatttctgactagtatgaatagagcagtaatgaacatgggtaagaaaatttctttgtaataagtttgtcctaatggtgtattcccaagctggatcttggagtagaactattcccattttctaaaggaacctgcacaatgatttcaaaagttgctgtaaaagtttccatttccaccatcagtgattaagaattcccctttctctgaatcgtcaccagcatgtgttatcatttgtatatggatctttgttatcctgattaggggaagatgaaatctcaaagtggttttggtatgcatatccctgataactgtggatgctgattactttaagtgaaaccagaatttgaatggccacttctgggtcattggaggaagcaatttataattgaatacacagagataagtaggggggtaagccatggaaattagaacaaaggaagacaatggaaggattactattcaaagagtaactattgagggaaaacaaccaaattgcatgagacatgccactgagggaaataataaacaattttaattcatcataatatatatatatatatatatatatatatatatattacaattttttgttttatcattaaaacggagatcacccagcttaagaatagccctttataatgagtttatagaccctgtgcagttgagtggtgagggatggtaaaaacattaaatttagagtgagattttaggtagagagagtaaaatatatgagagtagcaaaaggaaagagactacaggactacagcacaagaaataagccaggggaagatgtgttcttggtgcagaatctccctttgctcttaatagatctcatgttaaaattaccagaagaaaacatgttattttcgcaatagattacatccttgcccttataatgatatgccaagcttgaacaagtggttacctctgtactcacagcgccatctagctttcaacaaaacggaaagattgatggaaacctcttcaaaaggggacagggaggggaagaggggagtgtgaccagtaattgggtaggagaaaaggactgaagccctgagagccagcaaagagtggagaaaggcaaccctggaaggtaggaggtagagggatccttcagaatgtaccagagacctgggagctgagagactcacagaactcaaagggagggaccttagatgaaatgccctacagtagggagagggaacttgtagagcccacctccagcacaaagcaaggcattaagtaaaagagggtttgccatcccacagtcaaaaactctgacccataagtgttactgtcctaaagaactacaggggaataaatagagaagagcctgagaaaaaggaggtccagtgaaaggcccaaattgagatccagctgaaggggaggcccaaaggcctgacactattattgatctatggagtgctcacaaaaaggtacttatcatgactgccctccaaaagacacaacaagcagctgaaagagtcaggtgcagatatttacatctaaccaatggacagaagctacctgacccctgtggttgagttaaaggaatcctggaagaagctgaggcaacactgtaaggaggaccagcaatctcaattaacctggacccccaggatcaatcaaacactggaccatcaaccaggcaacatacaccagctattacgaggcccccaacacagatacagcagaggactgtatcaatcagagtagatgtgcctaactctcagagactggaggccccagaaagtggagtgtctggtggggtgggagtgggaggacatcctcttggaggcaggatgggagggagaaggtatggaatgttgaacagtcaaagggtggactgggataaaatctggagttaaaaaaattcagagacccaagtataaaaaaaggctgtgcttatttcaacaggaattaaattcatttcaacaaaatttaaatctcaaatcccaaatctactgtcttatttctagaggagataactaatttatgttagctttcagaacatacagtgtactgatgcaagacactctttgctgtcccatcatacatagacggctaaagagtttaaggttaataaaaattctttgggtctgactgattaaagaacagatacacagagatattttgccattgcacatacaaaatgaaaatgtaagagtgaaacaaatttaactgaccattgtatacatgttatttttgatccagtattttctggcacacacatatcacttcagttacactagaattcatataatcaacgtttcattggcccaaggtttgagtctaattgcctttaaaacattcttttagatgttcctcaactgcagaatggataaagaaaatatggtatgtctacacaatggaatgctataaagctattaaaattcaagacattatgaattttgcaggaaaatggatggaacttgtgaacatcatcctgaattaggtaacccaggtccaaaagtatatggatggcatgtacccacttataagtgaatattagccataaaatataggtactatgctacattccacagagaaaaagaatcaaggaggaaggcccaggtggggaagcttgaatctcacatagaaagggaaataaaatcatcataaaaagcagatggagagaaggaaatggtaggcatagagacagagaagtgaaacgaaggctcaagatcaggtgtggggaaggacaggagagatgcctagatagccatgaaagtgaatgggaatctataactggggtgaggaaggagggcatcttcaggacaagacagagttttaggataagggcgacacccaagaatcattgtgggtggccttaatgataacacactacacaggggatatggaacacaaagaggctacatcctatagccagggaagaacgccagtagaatgatagagataaaaaacaacccacaaaactttaaacccaaaatttatcctctctacaatatctccaactcataattgttcctgtgggaaagaattacagggatttaaatcgagaggagactgataaaaaagaaggttcagcgacaggcccaaagtggaattcagctcaaggggaggttgcaaggcctgacactgttactgagggtatgggtcactcaaaaaaggacctagcatgactgcccctccacaagatacaacaagcagctgaaagagtcagatgcagatatttgcaccctgtggttgaattagggaaggctgaaataagctgaggtaaagggccatcctgtaggtggaccagcagtctcaattaatctggacccatgagatctctcaaacactggaccactaaactgacagcatataccagctgatatgagactcccaacccacatacagtagagaacttccagttctgtgttcattcagagatgattcacctaaccctctagagactggagaccccagggaatttggaggtcaggtgtggtgaggagtgtggatatccatgttgagacagggggttagggaggaggtattggatgtggaacagtcagagggtggattgggcattgggtaataaaatatggagtgttgaaaaaatattttccaactattaaaaaaaagaaatgcagatacagggtatggggtagatactgagatgaccaaccaataatgagctcatcttaagatccatcccttgggcaagtaacagtctattaatgatactctgatatggttgcagataggagcaagttgtcctctgacatggtccacccagcagctgacccagaaagacacagacacttacagccaaacaatggatgaagtttgtggactattatgggaaaaatggggaagaattgcagccaataatgggatagaaactacacagaaagaccaccatagttaactaacctggaaccttgtggctctcagaatctgaaccactaaccaaagaacataattgggcttgaactagacctccccttacataacacttgttgcagatgtgcaacttggtcttcatatgggtcctgaacaactggaaaggaggctaactcaaaagccattacctatatgggggatgtgttcttacagctgagctgcttgtctggcttcagtgggagtggaagtgccagatatttgaaatgccagtttgagggggtaataaataggagggctcacctgctcagagaagaagaggaggtgggtggggcaggattgtataagaattgatatactagtcggatgggggcactagtgggatataaagtaaataagctttaaaaagtaataatttaattttaaaaagaatgataattttttttcaggactcctaaaatcacgtgggtttttcttttttgaaactgatatatattttatctgattctcaatatcagcataacaaaaatttaaattagacgtagaactctttaacattatctttcactgaaatttatgaaacaggtgattttgggatggtgaagtatcaagttataattcaattagtcaacaaaataagagccagggaaagaaaaaagtcctagtcttcataacttgggccaacaatcaaatatccctatttacttatcacaacttatattcatatagcctatatattataaaaaggcttacaaacaaggagatagattaagattggatggcaatgtctcatttatgagaggggaatccatgatatttcactctgtatattgtccagatatgggtctttgtatctggccccatctcctgtatatgctaacttctgtggtgacaatggtgcaatatactgatctatgggtttaataacaaaatattattagaagtcattgtgttgctacatattttagcagacaatagtacctgctttaagccttagacttggttactttaacatgagaacaatgtcaaatatgttttctgtctcattgtgtaggtctcaaatccagttagatagtggttacttattcccttgaaggggccactatcacagcagtgtatcctgtaggcagctgagtgtagtagatcaaatagtgtaggactgggttggtatttcaagtttcccctcactaaccatacagaatacttttcagtaccaacaaaactattcatcaggtaaaggctttagttaggcaaatgcttgtcttctctatgttcagaagaaatgtaggtgttgtcttcaacaatagagctatgctcagtttgtgtggagcaatcagtagcttaggcaatggtttgatttgtttggggtattaccatgaagacacattggccaagaaatatattagctataacccatatatgggattgaagatttcatttggtggcaagggaagtctagttgggtcattcctattatttggttattctttaagatttttttaaatattacatcttttagatgttatgtattcagtctactgtggtatctttcagactgatcatacttttagctgcttccattagtatttgcttaatcctcttcacttccccccatccatttaattgccccattccagtatcacctccaaatagtcccataattatttatattatttctaaatcctcaaaaaaattcttccctccatcctaatttttgcatgccgttgtcaagactttaaagctaatatccaaatataagctaataaatactatatttgtctttggggttctgggtaactcagaatgagatggtttttcgtttgttttatttttttgtttttgtttttgtagttccatccatttaactatgagtttcattattttgcttttttaacaggtgggtaatatttctttaaaatatataccatatttttattatcaatttctccactatgtataggtatttctaactattgttaatattacagcagcattgaataggaactaataaggaatgctataatatgatatgtactcctttagatatatgcctaataatgatacacctggaacttgaggtataacatttccagattcaaaacagaaaaccacacagattttcaaagtggtcatacacgtgtgtattcccaccagcaatgcataaggattcttatgactcaccatcctcaccaacatatttggtcattcattttattggtcttggccatactgataaatgaaaaataaaatcacaacatggttataatattcatatttctgattactaaagatgttgaacatttctttaaatgaaaccagcacttgaatggttaattatgggtaattagaggaggagatttatatttgaataccaaaaggataagttggtgaaagacatggaaattagagttacaaaagacaatgaaaagattagtattcctagagaaaccataacaaatagagcgcccaaaagctttggagcataattcagatggggatattaagcaatttcaacacacacatacaattttctgatttcatcgtcataaaagaggcaagccagattatgaatacaaatttcttgataaatataagcaacatgtaattcattagtgggggatgagaaaccatgaattgctaaacataatgggcagatatttcatagggaaaatacaaaatctgatagtagggaaattagcctactccaaaggaaattgtcgttaaaaatgtattcttacagcagaaagtcccttcaatactcacagatcctagacacagatttgattcttgcccttaaagcctgaagccaggtttgaaggagtgattacgtctgtgctcacagcgccatctagctttcaatgaaacaggaaggttgatggaaacatctacaaaaaagaagaaagcaatctcaggagggtagaaggagggagggacctggatgggaaagaggacaggggaacatgatctggtatttggtggagggaataagactaaagtcctgaaagccagcagacagaaagggaacaggcaacttcaggaggtaggaggtgggggaccatccagattgtatcagagtcctggtagctgagagattcttaggactcaaaggaaggaatcttagatgaaatgtcctacagtgggaagagggaacttgtagagcccatctccagcagaaagacagggcatcaactggagggatggggttgccatcccacagtcaaaaattctgactcataattgttcctgtcttaaagaactttagggacaaaatggagaaaaccctaaggaaaaggagatccagtgataggcccaaagtgggatcctgctgaaagggtgaccccaaagcctaacactattactgatgttatggagtgttcacaaaaaggggcctatcatgactgcccttcaaaagacctaacaagcagctgaaagatgcagatatcagatgcagatattttacacacaaccaatcgacagaagctgctgacccctgtggttgaacttggagaaagctggaagaatctgtgtaggagggtgaccctgtaggaggacaagcagtctcaaatcacctggacccccaagatctctcagatactgaaccaccaacaaggcagcatacaccagctgatatgaggcccccaacacatacacagcagagcgctgcaaggtctgtactcagtcagagaagatgcacctaacctcaagatactggatgcccaaggagtggggaggtctagtgggatagagttaaggggtatggatattctcatggagatggcaggggagggatggaatgtgaaacagtcagagggtggatgggggagggatataacatctgaactgtagaaaaagatttgatacttttttataaaagcacacaaatggacccaagaatattaaataactgtttttttttgtttctaaaatggatttaaagaatcatttcgaagccaaaacctatactttgatttctacaggggatatctaatgtgtgctcaccttcagagacatgggaagaatgatgcaggtctctgttagctaccacatcacattacatacaaattttaacaatagttaaagttcaatgagaagcctttcatgctgaatgacagaaataatggatggagagaaatatttagctatgagtacatacatagtagagatttaaacatgaaagtgatttaattgactattattatgtgtacatatttattcttcattttgtatggacatattctattccatatatttctttttaatttcggttaccctctgattcatataactaacaagactttattaaatgaaactaagaaactggaagaatggcaacacacagtcatgaaggaaatagcagtatttctggcaacagtagttgaaaatgccttctttagggatgacgattaactcttccagtttggcccaggacatgtgctagttttcattagggctgaaaaactagatctgtacaattgtagtgggagtctttctgaaaggaagacagttctcctggcaggtggattctctttgtttctcagtgcaggcagtgctgagaagccaggatgaagatagcccatccctccctaggtttctttgttttgtatgtagggcaaaactttctgtccttaaatatacctctcttcaattgctcctcaaaggttattgcttatcaaagtcttcaacctgtatcccatcattaaaaggtttctatttagattgcttgtttatgttgaagtctttgctatctaactttctactaacatcttataagctaagtctttcctaggataaacaattctgtttctagtgtcctttggctttatttacaaaaagtatggtttttaaatgaaaactttgaaatcttgttagtcagtttcagtgttaaatttctgttattttacatttaagattttctactatttgtttttaaattcttctctcattcattaaaaatcctatgctttcccctccctcctctccatgcagtcctccccatatctttcctgtcatccacatccactcctccaacatgatcttctaaaaacataacaaaacaaaaaaagagcaagtttctcagtgatatatcaactaaacatgtcataacatgttacaattaaactaggaacagccccctcaacaaggctgggtgatggaattgttcagtgatttaaatgttctgggtgacctaattgaaaggatgcattagatttccttgttacaattattgtttaatctcattactggagtattttgatgagagcatttagaaatagaacaaattatgaaagatgctttctaggcaataccaactggtataaacacacattaaagttactatgtccatttcctttctgtaccctccaccaaaagctaagatcttattgcagcgacctgagccagccagtagacccatgataggaagtcataaaagcactgcacaattacacctgcctctggtgagtgaaaatatgatgaaactacaaggaccaaagttccttttggtttcaacctccactggtgtcaaaaataaaagtcacccccatcatctttaagatactctggtcactggagcataaccaagtgatttgatttttcatatttcagatattgaatttcatcattagaatcttgagttttcaataatattaatattagaagtcctgccattttatcttaatcttgttttctttagacgtagatttacaaatgtgtactaacaaaagtttttcttttgtaaatattgacacaaagagttcagtattaattcagggattaagaagtcatgagttaatcagaccaagtttaaaatgaaaattttcatagaattttcaagaggtttgtaattttaaaaaaaaatattaattttaatctgaccccttaaatacaatgtgtatatctaacacaggatgtttgttttttaacacttttgccaaaatgactctagaccaaaatatgagagacaaacttttatagcatatatttactttagtgccacattatccaccttaaaatattataccaattaccttatgtttgcatgtgtattctcaattattttaagcagtttgtttcttttaatattcattactacttttacactgtcagtaaagctgttatttatgatagcaaaaaaaaaaacttcaacatagtcttcttgagacattttggttgtatcaaagtacagcataggatcttgggaattcatttatagccaaagggcatgtgaagggccagtgggtagaaaattattgaatactgaggaagactgtctcaagaaggatcagagtgatgagatatcatcttgaaagagggagggatgagaaatatattcagatgattatggtggtggattatttctcattgaaaatggtccttattaaggtagaatttaaagtgaaagtacatacataacataaaaatatcctgtataaaatttaattgtggaaagaatgtcatttttaggacatttaagaggcttgttgttgttgttcttattgtttctgcattttttattattaattacttttattacatttcaaactttgtccccttcccactctcccctgtgctaccccctcacctcattcccctcccattttcctctaagagaatgctcccccacccactcactaagcacctcacccctctagcatctccctttgatgaggcaacaaacttccacaggaccaagagtctcccctcccaatgatgccaaataagtcagtcctccactaaatatatagccagagccatggactgactcatgtatactctttggttgtggtttagtccttgggagctctgaggcatctggttagtagatactgttgttctttctatagggttacattccccttcagctccttcagaccttcccctaactcttccattggggtccccaggctcattccaatggttggctgtaagtatctgcatctgacttagtcaggtgctggaagagcatctcagaagacagctataccaaactcctatctgtaagcacttcttggcaccagcaacccagatgtcctttaatggaagaatggatacagaaaatgtggtactgttacacaataaaatactactcagctattagaaacaatgacttcagaattttgcagataaatggttggaactaaaaatattatcccaagtgagataacccagacccaaaaggaaatacatagtgtatactcactgataagtgaatatattggctcaaaatctcagaactcccataatacaaataacagaccatatgaagcttaacaagaaggaaggccaacttgtggatgcttcaatcccacttagaagcaggaacaaaatcatactgcttctgttatgattactttcccttgcattgtcaggagtcaatctctagaagtttatacttttccaaatgctcttctggtgtttaacagtttcattgcaataattaaagtttgtttagtaaaatctttccttttctttcttttatattttttgagacagggtttctctgtatagccctggctgtcatggaacgcactccatagaccaggctggcttcgaactcagaaatcgcattcctctgcctcccaagtgctgggattaaaggcatatgccaccacgctgggctaaatctttccttttcaaatgtatctcccatttctagtgaacaaccataatatttttcataaatcttaccataaaatgtgagctttactgaaattgatatacttcctcttgttctcaatatcagcatagaaaaattaaaattaaaaatcaaattacttgaatttaccctttcactggaacttcttttttattttttgtagaatttttctcatttatttatttttattagatattttctttatatacatttcaaatgctatcctgaaagttccttataccctccctctgccatgatcccctacccacccactccaggaacaaccaagatacaatttgcaaaacacaagaaaatcaagaagagggaagaccaatgggataatattttattcctccttagaatagggaacaaaatacccacgaaaggagttacagagacaaagtttgtagctaagatgaaaggatggactatccagagactaccccacatggcgatccatcgcataatcagccaccaaacccagacactattgcataatgccagaaagattttgctgaagggaccctgttatagctgtctcatatgaggctatgccagtgcctggcaaagacagaagtggatgctcacagtcatctataagatggaacacacggcccccaatggagaatctagagaaagcacccaaggagctaaaggggtctgcaaccctataggtggaacaacgatatgaactaaccagtacccccagagctagtatctttagctgtatatgtagcagaagatggcctagtcggccatcactgggaagagaggccccttggtatcattagaacctctgatacaagataggaggtatgctgagatctgtctcagtcttaagagccagccagggagttgtggatatagggaaaagaactgtttcacagatctcatatcatagagtgacacaaattctattgaaatggtcaatagttcactttgacgtttatgtccgtatgtcaataatttcctcataaagccaatgatgttaggacatagttcatataacatcatttcatagttttgtatcactgtcaccagatgaggaaagtattttctcttttctgttagaaatatatttctctgtgcttttgcaataaattcttaacttgtggaaaaactgtttagactgcaacattctctgaaggtcatagaggctttcaaagcatttatattaaaatttaaggaggttaaatgttaacacttgtaatattgtcattaaaaacaatgcctttgccctaagggatttctcagaagttaagagtgctgactactcttccagagaaactattcaattttcatcacctacttttctccttaccatgatttgttttaccagatacaagggaactgcagcactcttctggctttttcaggacctccaagcatctgctccatagacatgtattcaaacactaatacaagacaacaactaaataaaatagaattttttaaaactcaacctatgcaagtgtcatacttttcagaaaactgagtctaaatcagcaaaaatgatttatttttaggattttattaaattttggaatttattgttattcaataaattctgactttgtgaattatcaaaaatgtctatcaatgactttagtagtatgcttatggcacagaaaaatcctgactatacatgattttcctaccatatgtttctctccacttttgctggaggaaatttgtcctctgcaatggtatttcctgaagaagatgattagaaatgcagtgaaaatggttctagtgatatttcctgacaaaccatctttgtttataaaccaataaaaaactcaactcactgtaaccccatatacatgagttttactcatgatggattgctttatgctctatgtgaacttctggtaattcctaattcctgtaaatacagggcttggggtataggtataaggctgggttttagggaaataaactattaatgaaacgtacaataagctagaatctgcattgtacagatattctggatttcatattgccaattgcaaattttccaaaagaaaggtttattggttggctaagcaaagaaattaaagatggctgataggaaagaaatcagtaagatttgacattcggtgatttcaaggccagcctgtttggaggcatttgaccaccatcctctatccagtaggaaatcacaaagaatttccaattatgtctgcacacatgtgcacctggtgagaactttggtggaaatttcaagatgtttttgaaaccatatgattttttaattgaacatgctagcaaaaatctaccgtggttaaaaaaaaggaaactgtactaccatcataattcttagatgtctctttctttattccactttctcttcagctttggcatcagtgctgcaggaatttagatcatcttcggctgtgccttcacgtggtgaagaaagctccccactctattgaaaatggtgctcacattgctgacattggttaggcctattgcacacaagccaaactaataaggtccaacaataacattatgtaccttaattagaatgttgatcttatcctctaagacagtcaaattgtccctagctacatcctaacacaggctgagtacagaatagatgcaggatatacttaatgctcctgacatagtgttagtcactggaagggaaatcctcatctcaaagatgcacccctgccttccctatgaagcaccaagcaccttggtgccattagacatatagcattaggatctgacttaagctgctgtgtatagtatctttgtagcattttcccatcactttctccactggaaaaaagctctctcaaaatagctgtctacttagttttcacgagcacattggttttttgtttgtttgtttgtttgttttttcatctctgtcatgtgtcccaatctcaccaccttcaatctctccttcattcatattgaatttgtcatggctatattatgtactggatatgctgaacattaaaactgcctaaatccagtggaaaacttctcagccatggccctggctcaatcacttgtagagccttcatttgctctacaatcatgcaaggaatatttcttgctattggattttatttgaccatcattttccttccagatttcttgaacaaaaatagttttcttctttctactgcagaatacaatcctgagtccatcctcattatcagctttgaaacaataaggtcattgacctttgtactttttatttggaaaatctacctcttgatgatcagtgtggatttgtcacaatctgtattaatcagccctacttcctttgagtattcttctactttgtaggagtgaggcaactggaaaacaggaaggaaaaattgatgacctgaggttgggtattcggtgattcttttgagatgacttgtgaataatttcttatcagctgatctatttcctctagcggctgacatcttcagaatctactgattcttcagatttatgttgactaacatctttctacatgtcactctatttctcttctcttctcctctctctctctctctctctctctctctctctctctctctctctctctctctctctctcatttctttttcattacatatataggcctctgcttttaagaagaacacattataatttttattcaatctcttaggaaatatcctccagaattcctgttcttcatgagctacaccttctttcctgaatatattggaggaaatttcaattcagaaatttcaataccagagcaactaaagtgaaaaccttgctttattgaataatgaatgctggccattttggtcgaaacaatcaatcagttgtgataaagacagaccagcatcagaagtctctgggaagtgatgcttcagggtcagcatgcagaaactgtgttgtaaaaatgacaaggtcataagtgtgttccataatgaacttattagtgactagattaatcaagtggcactggatatgaaggcatggagacatcatggacaggcactgaggcttgtaaccatgtggcagggatgggtttcactactgttttcagtgaaacccagttgcttcaaggtacctcagtgttttgggtatgcaagtaccatagaataaccagaaaaattagcagcagccatggggtcaaggcagtcataacctagaatactagctctatatttgttgcagagggcagagctagaggcattagttacccagaccctttaaagggtagcaggaaatagtcagtgggtcacagatattaatatatcgagttattaacactgctgaggattgatttttgctttgttcacatttttgcttgataatacttccttgaagaaaaggagtacttaaaaaaacacaaaataggcagttgctagatgggtgaggcaggagttagtgagttttaggaggagcactctcatagaggcaaagggagggggaaaggggagatgagatggggatttgtgcaggagtaatgaggaagggggatatcttttaaaatgtaaataaatagaattgttaataaaaatattaaagagaaaacatatttttttacaggatcccattcttcaaaatgagatttcagaattttatagagaatttggattttaaaagacattagttttttttaaagatactgaatttttaaaagtgtttgaaatggccaggttgtgagactctgtaagtcctactagtatagatacatttgatattcaacttttggtaaagaactgactaccactcacaatttttgtgttgatctatatcacaaatgcaggtcatatcatacacataggaaaatacagcatccagaagttagaggaagaaaaagttgaagcttaaagtcaacctaagcatttctcaggacagcctgagtccattgcagagtagaggtaatatgagatctgtgccgttatgtgctggagaaatgtaacttgcttttgattttataggagttacatagaacatattgacttgaggctcagaagacactttgaacttttaaacattattcattctctgaaagatgatgagctcttttaaagttttacagtatacaattttattatgatatggttgtgagactgtgataataaggtgtacagtgcagtgttttgaatgagatgcccactatttgtctcgaattttcaaatacttgactcctagttgatggctgtttggggaagattagaagatgcagcattgctggacaaaagatatccctggggatagctttctatctttcaaaaatctcatgatgtttcaaagcattctctcttcttcctctctgtggtttgagatataagctgctacttcagcaaccatctgcttgccactcaaatagagaaagactggacataatcttttgctactataattttaattttattatttatattttattgttaatacagggttcaaaaatgtaatcctggctgtagttaaacacaatatgcactctctatatatggcttaaatatatgtgccatgatgcctggactttttcactaaaatattaattgtaaatataattaatgattaaagccaaatgcacatttaaaatgaaaaaaaatcattgtatattggcttacatttgtaaccatataattcaagagatataaacaaaatgattactaaatgtttgatactatccttggatacagaatgagattctttctcaaagttccaaacataaagaaggagtgaacaaaaggaaaaattaagtaaagaggaggaggaagaatgagaggcctctaatattcagatacaattaaaatctcaagacacatgagttaaatcattgtcacatgcaaactagacttctctggtatgtgaatgagtgagtttttggaaaaattgagcatataaaattagagatctctggagagaaacaaaaacagtaagtacacagtaatgtaccctgctctttgggtcaattttgagatctattaatttcactttgctacaactcttctagtgcccatgttacatagtcattgaattcagcaatataagtcctcttcactatatcaatatggtaatcagtacacagaaatttatataacttgcaaagataatactgtcaattctataattagaataattagaatcaaatgcaaaaatttaaatgcatgatatatatacatagaatatcatagtatagattacattgtatatgttatacaagtctttatccttaggtattattgaaatagttattctctctttcaacttgaagagatctagactcatctgtgagacaagcttctatcataattgagtgagattagcttaactaacctaatttaggtaggagaacatgtccttatgggtagcacaaagttgtggacccttaacactgtcctcttcactaacaagttggatttctgtgtcccaagcaagaagtctaaaacccaaatccagcgattgacacttctacatacatacagacaattacttattactttttagataaaaatgtaatttatttaaaaatatagggctttctctatgtgttttcagcatcctaatgccaccttgactcttattatattaagagctttaaaaggtcttggattcattttcttttttagctaaccatatataacccttgtcttttgtcactattgtataaaatctgtaaggtatattaactcatgatacgacaatcttatatcttaatatgataggatgcagatgaaaatagaatgcttttaattctaggtctatctgttcgaaacaatatctccctggtcagaaagtgctattgatgctaacattgtctttaaaaataataaatcagtctgtcttattgagtacttgtttcaaggcatcttctgacaactttcatgaagacaacaccactgcattgtagtttcattgtctttttcctactaggaaactatatttgaaaggtatctaaaagtgcaagatgacagaaaatagtatcttttcaacaagatttaaatttctccaccactggcagaggttcagagggactaatatccaggagcacagcctgtttaagtgtagtcatatccttctcccaatatggcatgaatttatatattactatacctaactgttcattcctacactgcagcacatttagtcacacagggagcttctgaaagttctaccatgggaaagtaagcagggtatttaaatttgctttcaatgccacatttatatttttgtagatctctttccttccataattttataatgaactgtatagagtgtgcaaatataaatcacagtttgatgtgtttcatgaagccatggaaatatttttgtggagtgcatcccttccttcgaggtaccaaccataggatggttctagtataggatagagtttatttgggggtatagaaaggggagttgataaggaatagagactgagaggaggaggaggagagacagaaagagagagagagagacagacaaacagacagacagacagacagacagagacagagagagaagcggagaggagaggagaggagaggagaggagaggagaggagaggagaggagaggagaggagaggagaggagaggagaggagaggagaggagaggagaggagagaagatatgagccaggaacacatggaaaggagaaaaaggaagaaaaaaatgtgcaggcagaggcagagaaagagaaaagatgccaaatggtcccttttattgcaagtcaggcctaactggctgttgataatgactattgggtagagcctagaagaaggaatgctaaggtgctaacattcctccagttttgtttaattaaaaaaggagaaactagaaagaggtggtggtgaagcaggagtagggtcattgtgatctttagttgtttcattttgactttgcggtgagatgtgcctgggagcctaagaaaatggggatggggatgttggttaagtcttaggagagttggatgtttccttgctgtccatggtctaccgggccttctgtagataagaaagcgcaggcccagaagagtgtctgtttctgagaataagctggagatgctgcacttctggagctgtcctggatgtagagtttgagtaaatgcctggattttgcaaaatgctcaaacacacatggacatgaacatgcgcatgtgtgcgcacacacgggcgcgcgcgcgcgcacacacacacacacacacacacatacaacttaaaaaataaagttaagttgctttggtagtaaacattttcttaggtgtatatttaaatcctttaggtcttggatgttgagatgaggggagttccaaatccagggaacaggagaggactatgtaatggatagaaacttaggctattgattggcagatggagtctgtttggtccatgagaagtaggtgtgagtgtgattcctggacctaataaatttgcaaaagagacgtttgctaacaccatgaacagtgtttaagccgaggttagggaagataaaaaggttttgtggagcacaaggaacaagaagggttttatccttccctctaggggactgaatatatataatgagaagaatttttaaatttacatttaaaaacaataaaaatttgataatcttgtgactatgatagttgatcatataaaattattatgagaaacacctcaagtctatagttaaaagacaaccaaaagaaacttaaattatcatgagaaaaactttaagtatgtaattagcagacgatcaaaggaaacttaaaatttacacttgtgattatagaagttgtgttaggctaatttatcaggactccattgatcaaaattataaatgaaattcttaaagtctcgatataacagtggaatactaaggggaagaaatatgaaacatttagtcactggaaattgagtttaaataggaagttagaagaatattatctctgtgaaagcttacatctgaacttgtatatcctttatcatgaagtctatgagaaagacaaacctatctgtctttttgataagagatctgagaatcttaactttttaatgagttgactaatgagctaatatggtaatggattacctagatctaaggaaatagaggtctgttttctagctgtcaagatgccatttgtttagctgtcaatgtaataaaaaatctgagaagaataacctatcacttagatgtcatatactaattaaactgacagaggttagtttatagtccacgacctaaacagttttcccaggtccctgtggtctccatcacatttcaggcagaggtagtctgcccatcaggcctagacagtgagaggctttatgctgtggagcaagaatgcaggagcaatgactcaccttatctttggcaatatgtagcacttagttctctgggtgtcatgtatttgtctatagattgggctgagcccttgcaccagtcaaggaaagagaacaatctctcacagtgggcatcataccacaatccaggtagagttacttgtcgctgtgtctgtgtcttcttggagacattatcggggttcactgttaggatttggagatctctgtctgtcatagtaaacttaaacacttgatgttatatttagcagctttctgacaagattgagttctaggatctattgagtatatctgaattagacaatttgggtctggttttaactatttgttctaggttgtatccaggaaacaatgagagtacattataacttgatgacagtaatgacagcagcaaaaacaaggctaaatatatatttaaggcagtgatcattaacagtttcattgttgtgaatctttagaataatattaaaattcttatttacaaaggcagtatagaaatgaatataaaacttttttcttaactgttaagtgtctttggcaactttaagtcaggatgttaccctaaagacagatgtgaagtagggactgcctatatcaaagatgtcagatagtcatgagctagcctacaaccaagatagccctgaagttatagctccagctgtggaggaaaatcatgtgtttgttatatcttagaatggaatgacagttatctgtagaagcatggctatatatcagcaaagacaaacatacaaagatacaaatgggaatattctgtctggtagacaaggcattatgtgaagatctctccctgttgccacaagcagcctctaccactgagctggtcctagtggcatgggctgagcagcacagtctaagtggtggatggtggtatctgaggcaggcacatggagcatctctgctcctctttctcccaccacagctgacttaaagctggtgcagatcagaatgaaaaggaatcagagataaaatctccaaggaagtagaaatttacgactgcctgttggagcaaacagctagtagcaacatttgctacagaatgagttaagtctgaaacaagatctcagatccacagggtcagagagcagagggaaagctagctggatcaaggaaaaaaaacagttgggaggaaaagtgggcaaaagcctgcacaaacaaacaccttccagttttcagaacactggtgagagttttaaacatttttttcaatgtgcagttaagtggccatttagagctattatcttacagatattggggccaaatttaccctgtgaatttggaagccattaagaccatgaaacatcacaatatggagcttggaaatagcaatgaaaccattgcctttaaatgaggataagagttattaaccttatcacttgtggtgtcccgaggataacttaataactaaatatgaaatgagcagccagactagattatcaggtcatcaggagataacttgggggttgagctgcatagctagttcctgagctgtggggtcagtgcccaaggaagaacattttacctaggcctaggattttccagcagtgagagagagaaaagccatttcaagtaaaaaagagtgcttactcaaagttagagctcctaaaatgaggagtcaaccaaaaaggcagtcatgtaggctatgaatacctctgtgtcccaagacactataggcggtagatgcaagctcaatagtggccaggggccatttactctgatgtgtgtgtgtgtgtgtgtgtgtgtgtgtgtgtgtgtgtgtgtccgggatgcttaccaatttatctatgattggatagagagaaatatcaatccaatggctggaatgtccatgaggtggcaggaaatgtgaacctgccaatgtggaaatacaacttactgcagcaaatgatgagttttaaagccagggatatagttttgtggaacacaatttggtgcgatgggtgcctcagcaggcccatgctgaggcatcccttcccccaaaaaaacaagtcataggatgggtctagtatacaatagagttgatttgggaaatggggaggaaagttgggaagggagtatggacagaggaaagagagagagagagggagagagggagagagagagggagagagagagagagagagagagagagagagagagagagagagagagagagagatcagttgtgaacacctagagaccaggggatgtagaagtagagtgggagaaggagaaaagagagataagagggatatagagagatcaaacagtcccttttatagcaagactacctggctttaggtaggtaactgatgtgcagaacctagaaggaatgctaaagagctaacacatttggtagttccttatgcatttccctttccaatgtcatgtactccttgacttccagaaaagatattaacaagtcgtatttacatttgctggaaaataattgtgtatgaacatttaaaatcagaagtcctcctacatttttgtttgcacattcattttcatattcagcaggcatctaaatcaccaaggcttaaaggtgcatagaagaccctgagtgatgttttttgcttgtgaaaaccaagtactgctctgcaagatttccaataactcatgtcagaaatctcaaacctaaatataactgtatttctggagatatacacaacctttggcacctatacacatatgctcattctctctctctctctttctctctctctctctctctctctctctctctctcacacacacacacacacacacacacacacacacacacacacacacaccacagaggcagagacagagagacagagacagagagagagaatggagacgaacaaagacagagaaacagagagaaaaacaaagagaaagacacagagaaagatgtatataaatggttaaaaatcatgaaatctaggtaccattgtgccacatgcctttcttctagcacttaagaggcagaatctttcttagagttcaacgaaaatgaagccaattcatacccaaacttatgggacacaatgaaagcatttctaagagggaaactcatagctctgagtgcctccatgaagaaacgggagagagcacatactagcagcttgaaaacacatctaaaagctctagaaaaaaaggaagcaaattcacccaagaggagtagacggcaggaaataatcaaactcaggggtgaaatcaaccaagtggaaacaagaagaactattcagagaatcaaccaatcgaggagctggttctttgagaaaatcaacaagatagacaaacccttagccagattcactagagggcacagggaaagcattctaattaacaaaatcagaaattaaaagggagacataacaacagatcccgaagaaatccaaaaaaccatcagatccttctacaaaaggctatactcaacaaaactggagaaccttgatgaaatggagaagtttctagacagacaccaggtaccaaagttgaatcaagatcaggttaatgatctagacagccggggatatcccccaaagaaatagaagcagtcattaatagtctcccaaccaaaaaaagcccaggaccagatgggtttagtgcagagttctatcagaccttcaaagaagatctaatcccagttcttcacaaactattccacaaaatagaaacagaaggtactctgcccaattcattctatgaagccacaattactctgatacctaaaccacaaaaagaccccacaaagatagagaacttcagaccaatatcccttatgaatattgatgcaaatatcctcaataaagttcttgctaactgaatccaagaagacatcaaacaatcatccatcctgaccaagtaggtttcatcccagggatgcagggatggttaaatatatgaaaatccatcaacgtaatccagtatataaacaaactcaaagacaaaaaccacatgatcatctcattagatgctgagaaagcatttgacaagatccaacacccattcatgataaaagtcttgtaaagattaggaattcaaggcccatacctaaacatgataaaagcaatctacagcaaaccagtagccaacatcaaagtaaatggtgagaagctggaagcaatcccactaaaatcagggactagacaaggctatccactctctccctacgtattaaacattgtacttgaagtcctagccaaagcaattagacaacaaaaggagatcaaggggatacaaattggaaaggaagaagtcaaaatatcactttttgcagatgatatgatagtatatatatgtgaccctaagaattccaccagagaactcttaagcctgataaacagcttcagtgaagtagctggatataaaattaactcaaacaagtcaatggcctttctctacacaaaggacaaacaggctgagaaagaaattagggaaacaacacccttctcaatagccacaaataatataaaatacctaggcaacactctaactaaggaagtgaaagatctgtatgacaagaacttcatgtctctgaagaaagaaattaaagaagatctcagaagatggaaagatctcccatgctcatggatcggcaggaccaatatagtaaaaatgggtatcttgccaaaagcaatctacagattcaatgcaatccccatcaaaattccaactcaattgttcaatgaattagaaagggcaatcggcagattcatctggaataacaaaaaacctaggatagcaaaaactcttcttcaggataaaagaacctctggtggaatcaccatgccggacctaaagctgtactacagagcaattgtgataaaaactgcatggtactggtatagcgacagacaagtagaccaatggaacagaattgaagacccagagatgaacccacacacctatggtcacttgatctttgacaagggagctaaaaccatccagtggaaaaacgactgcattttcaacaaatggtgctggcacaactggctgttatcatgtagaagattgcgaattgatccattactatctccttgtactaaggtcaaatctaagtggattaaggatctccacataaaaccagagacactgaaacttatagaggagaaagtggggaaaagccttgaagatatgggtacaggggaaaaattcctgaataaaacagcaatggcttgtgctgtaagatcgagaatcgataaatgggacctcataaaattgcaaagcttctgcaaggcaaaagacaccgtcaataagacaaaatgaccaccaacagattgggaaaggatctttatttatcccaaatcggacaggggaataatatccaatatataaaaagaactcaagaaggtagactccataaaatcaaataaccccattaaaaaatggggctcagaactgaacaaagatttctcacccgaggaataccgaatggcagagaagcacctgagaaaatgttcaacatccttaatcatcagggaaatgcaaatcaaaacaaccctgagattcaacctcacaccagtcagaatggctaagatgaaaaattcaggtgacattagatgctggtgtggatgtggagaaagaggaaccctcctccattgttggtgggattgcaagcttgtacaactactctggaaatcagtctggtggttcctcagaaaatttgacatagtactaccggaggatccagcaatacctcttctgggcatatatccagaagatgccccaaccggtaagaaggacacatgctccactatgttcatagcatccttatttataatagccagaagctggaaagaacccagatgcccctcaacagaggaatggatacagaaaatgtggtacatttacacaatggagtactactcagctataaaaaatgaatttatgaaatttctaggcaaatggatggacctggagggcatcatcctgagtgaggtaacccaatcacaaaggaactctcacaatatgtactcactgataagtggatattagcccagaaacttaggatacccaagatgtaagatataatttgctaaacacattaaactcaagagaacgaagaccaaagtgtggtcactttgccccttcttagaataggaaacaaaacaaccatggaaggagttacagagacaaaatttggaagtgtgacgaaaggatgtaccatctagtgattgccatatccagagatccatcccatgatcagcttccaaacgctgacaccattgcatacactagcaagattttgctgacaggacccagatatagttgtctcttgtgagactatgccagggcctagcaaacacagaagtggatgctcacagtcagctattgaatggaccacagggcccccaatggaggaattagaaaaagcacccaaggaactaaagggaactgcaaccctataggtgaaacaacaatatgaactaagcagtaccccggagctcttgtctctagctgcatatgtatcaaaagatggcctagtgattgccatcactgcaaagagaggcccattggacttgcaaactttatatgccccagtacaggggaacgccagggccaaaaagggggagtgggtgggtaggggagtggggggtgggtatggggggactttaggtttagcattggaaatgtaaatgagctaaatacttaataaaaaatggaaaaaaacttttaaaaaagaggctgaatctggttgaactctgagttaaaagcaattctcatctaaaaagtgaggtcccagtccagcaaattctaatgaataaaacactgtttcaaaataaacaaatgaaaataaatttaaaagtacatcatagtaacatttatttaaaaacacgaggaaaaaattcatcactgaatgataaaacagtgcttttattaaacaacaaatattacgttcatcctaagggtttatttttcgtgaacacataggaaattttaaagatacatctaattaagtaaaacctgattaatgcagaatgttgttaaagtagcagtttttaatcgatagtgatttctcctgatggtactataagaatctacagcttttggactttccctagtttgcttacaatttttctaagcactctttctttccttggtatagagatatgaaggtgaatataattcaatattatgtagtcatcattgcacagaaaacaccttgagtatattcctgaccaatttatgtagggttttatgaagaccctcctctttcatactagcaataggacagcttacagctcatggccacctgcttttgtcattagctttacaaaagatttgaatccctgcagcctggcaaacatccatgcatgcgtgattggaaggctgtgcaggctctctaaaacaggctgggggttgggagtgtgattagtcaagtcagtgcagcaggtcctgctcagagaagaggcaggcaaagatgcctgtcacatccaccctaggaatggtcagcaaggcaatgcagcaaacaaggtcagctcccactttgaccccttgtttctttcatagtagattcatagtagaacatgatttgtgcatattaagtattgcaaatttgttgggattagaacatgattctatagatctcaagtctttagctgaaaaatcagatgagaaagctatgagatcattacctggcttcctttgtcctgtcctgtgttgtgttgtctgtggtgcccctccccttcagcggtcaatctgccctgtcacatcagctcagttctcttacagggtgaacattaacatttcaaagtgctgacagtactgtggattattggtgtgtaggacaaagggcagtcaggaagaaaaaagaacatttatatttacagggatgtttcataaaaataatattcctaagcgaatttaagttagattatgccatgccctgaaggatgggaagggattaaagcacttgagggttaacatagagattatcatcagagggaagacacaacagataatggtaggtgccagtttccagatggaaaggatgatcaggtacatatgacttttgacagtataatacctataacacaggaacaaagagtccaaagtggctttaagaaagagtagtggagagtaaattcaggtgtgttaactaccaacatatgaaaacacggggtatctttcacacacacagaaacacacaaacacacaaacacactcacatacacacacctgtgtacagtggtacagaataaaccttttttctgtgatttcataatggaacctaatctgaatgtttacagtcatttaggtctttagatatttgttatttatttttattagtattagtattagtattattttgttatgttcagattaaacaataaactagtgaattagtaagaactttctttggatatataatcaactttttttattttgctttgtcccttgatttgattgaagtttatagatattcaaaacagcatggtgatttttttgttcattttctaccagataaataggaaagggtctctgttgtcttttgtttttgtttgtttgtttgtttgcaggtgattttgtaagtgtattttgtttttcattaaaaaatggtgttggagcagcagcggtcgccatcttggttccgggactcagcagaacttaggaaattagtctgaacaggttagagggtgccccagagaaccggacagcttctgggacgggcagaagcacagagccgctgaggcagcagcctgggcgggccacagacaaccggccaccatccggaccagaggacaggtgtccgcctggcttgggaggcggcctcagcctcagcagcagcggtcgccatcttggttccgggactcagcagaacttaggaaattagtctgaacaggttagagggtgcgccagagaaccggctgaggcagcagcctgggcgggccgcagacaaccggccaccatccggaccagaggacaggtgtccgcctggcttgggaggcggcctcagcctcagcagcagcggtcgccatcttggttccgggactcagcagaacttaggaaattagtctgaacaggttagagggtgtgccagagaaccggacagcttctgggacgggcagaagcacagagccgctgaggcagcagcctgggcgggctgcagacaaccggccaccatccggaccagaggacaggtgtccgcctggcttgggagacggcctcagcctcaggagcagtggtcaccatcttggttccaggactccctggaacttaggattttagtctgcacaggtgagagtctgcaccacagaagctgacagcttctgggaactgccaaagcaacacatcttctgagagaggccctgttttgggccttcttcttcgaccaggaggaggtccaaaaacaagatatctgcgcaccttccctgtaagagagcttgccagcagagagtgctctgagcactgaaactcagaggagagaatctgtctcccaggtctgctgagagatggtaacagaatcaccagaagaacaatctctaaacagagtcaactataactactaactccagagattaccagatggcgaaaggtaaacgtaggaatcctactaacaggaaccaagaccactcaccatcatcagaacccagcactcccacttcgcccagtccagggcaccccaacacacccgaaaacctagacctagatttaaaagcatatctcatgatgatggtagaggacatcaagaaggactttaataaatcacttaaagaaatacaggagaacactgctaaagagttacaagtccttaaagaaaaacaggaaaacacaatcaaacaggaagaagtccttacagaaaaagaggaaaaaacatacaaacaggtgatggaaatgaacaaaaccatactagacctaaaaagggaagtagaaacaataaagaaaactcaaagtgaggcaacactggagatagaaaccctaggaaagaaatctggaaccatagatttgagcatcagcaacagaatacaagagatggaagagagaatctcaggtgcagaagattccatagagaacatcggcacaacaatcaaagaaaatggaaaatgcaaaaagatcctaactcaaaatatccaggaaatccaggacacaatgagaagaccaaacctacggataataggagtggatgagaatgaagattttcaactcaaaggaccagcaaacatcttcaacaaaattattgaagaaaacttcccaaatataaagaaagagatacctatgaacatacaagaagcctacagaactccaaatagactggaccagaaaagaaattcctcccgacacataataatcagaacaacgaatgcactaaataaagatagaatactaaaagcagtaagggaaaaaggtcaagtaacatacaaaggcaagcctatcagaattacaccagatttttcaccagagactatgaaagccagaagagcctggacagatgttatacagacactaagagaacacaaattccagcccaggctactatacccagccaaactctcaattaccatagatggagaaaccaaagtattccacgacaaaaccaaattctcacattatctctccacgaatccagcccttcaaaggttaataacagaaaaaaaccaatacaagaacgggaacaatgccctagaaaaaacaagaaggtaatccctcaacaaacctaaaagaagacagccacaagaacagaatgccaactttaacaacaaaaataacaggaagcaacaattacttttccttaatatctcttaacatcaatggtctcaactccccaataaaaagacatagactaacaaactggctacacaaacaagacccaacattttgctgtttacaggagacacatctcagagaaaaagatagacactacctcagaataaaaggctggaaaacaattttccaagcaaatggtatgaagaaacaagctggagtagccatcctaatatctgataagattgactttcaacccaaagtcatcaaaaaagacaaggaggggcactttgttctcatcaaaggtaaaatcctccaagaggaactatcaattctgaatatctatgcgccaaatacaagggcagccacattcattaaagaaactttagtaaagctcaaagcacacattgcacctcacagaataatagtgggagacttcaacacaccactttcaccaatggacagatcatggaaacagaaactaaacagggacacactgaaactaacagaagtgatgaaacaaatggatctgacagatatctaaagaacattttatcctaaaacaaaaggatataccttcttctcagcacctcatggtaccttctccaaaattgaccacataataggtcacaaaacaggcctcaacagattcaaaaatattgaaattgtcccatgtatcctatcagatcaccatgcactaaggctgatcttcaataacaaaaaaaataacagaaagccaacactcacgtggaaactgaacaacactcttctcaatgataccttggtcaaggaaggaataaagaaagaaattaaagactttttagagtttaatgaaaatgaacccacaacgtacccaaacttatgggacacaatgaaagcatttctaagagggaaactcatagctctgagtgcctccatgaagaaacgggagagagcacatactagcagcttgaaaacacatctaaaagctctagaaaaaaaggaagcaaattcacccaagaggagtagacggcaggaaataatcaaactcaggggtgaaatcaaccaagtggaaacaagaagaactattcaaagaattaaccaaacgaggagttggttctttgagaaaatcaacaagatagataaacccttagctagactcactagagggcacagagacaaaatcctaattaacaaaatcagaactgaaaagggagacataacaacagatcctgaacaaatccaaaacaccatcagatccttctacaaaaggctatactcaacaaaactggaaaacctggacgaaatggacaaatttctggacagataccaggtaccaaagttgaatcaggatcaagttgaccttctaaacagtcccatatcccctaaagaaatagaagcagttataaatagtctcccagccaaaaaaagcccaggaccagatggatttagtgcagagttctatcagaccttcaaagaagatctaattccagttctgcacaaactttttcacaagatagaagtagaaagtacctacccaactcatttcacgaagccactattactctgatacctaaaccacagaaagatccaacaaagatagagaacttcagaccaatttctcttatgaatatcgatgcaaaaatcctcaaataaattctcgctaaccgaatccaagaacacattaaagcaatcatccatcctgaccaagtaggttttattccaggaatgcagggatggtttaatatacgaaaatccatcaatgtaatccactatataaacaaactcaaagacaaaaaccacatgatcatctcgttggatgcagaaaaagcatttgacaagatccaacacccattcatgataaaagttctggaaagatcaggaattcaaggcccatacctaaacatgataaaagcaatctacagcaaaccagtagccaacatcaaagtaaatggagagaagctggaagcaatcccactaaaatcagggactagacaaggctgcccactttctccctaccttttcaacatagtacttgaagtattagccagagcaattcaacaacaaaaggagatcaaggggatagaaattggaaaggaggaagtcaaaatatcactttttgcagatgatatgatagtatatataagtgaccctaaaaattccaccagaaaactcctaaacttgataaacagcttcggtgaagtagctggatataaaattaactcaaacaagtcaatggcctttctctacacaaagaataaacaggctgagaaagaaattagggaaacaacacccttctcaatagtcacaaataatataaaatatctcggcgtgactctaactaaggaagtgaaagatctgtatgataaaaacttcaagtctctgaagaaagaaattaaagaagatctcagaagatggaaagatctcccatgctcatggattggcaggaccaacattgtaaaaatggctatcttgccaaaagcaatctacagattcaatgcaatccccatcaaaattccaactcaattcttcaacgaattagaaggagcaatttgcaaattcatctggaataacaaaaaacctaggatagcaaaaactcttctcaaggataaaagaacctctggtggaatcaccatgcctgacctaaagctttactacagagcaattgtggtaaaaactgcatggtactggtatagagacagacaagtagaccaatggaatagaattgaagacccagaaatgaacccacacacctatggtcacttgatcttcgacaagggagctaaaaccatccagtggaagaaagacagcattttcaacaaatggtgctggcacaactggttgttatcatgtagaagaatgagaatcaatccatacttatctccttgtactaaggtcaaatctaaatggatcaaagaacttcacataaaaccagagacactgaaacttatagaggagaaagtggggaaaagccttgaagatatgggtacaggggaaaaattcctgaacagaacagcaatggcttgtgctgtaagattgagaattgacaaatgggacctaatgaaactccaaagtttctgcaaggcaaaagacaccgtcaataagacaaaaagaccaccaacagattgggaaaggttctttacctatcctaaatcagataggggactaatatccaacatatataaagaactcaagaaggtggacttcagaaaaacaaataaccccattaaaaaatggggctcagaactgaacaaagaattcttacctgaggaataccgaagcacctgaaaaaatgttcaacatccttaatcatcagggaaatgcaaatcaaaacaaccctgagattccacctcacaccagtcagaatgtctaagatcaaaaattcaggtgacagcagatgctggcaaggattggagaaagaggaacactcctccattgttggtgggattgcaggcttgtacaaccactctggaaatccgtctggcggttcctcagaaaattggacatagtactaccggaggatccagcaatacctctcctgggcatatatccagaagatgccccaactggtaagaaggacacatgctccactatgttcatagcagccttatttataatagccagaagctggaaagaacccagatgcccctcaacagaggaatggatacagaaaatatggtacatctacacaatggagtactactcagctattaaaaagaatgaatttatgaaattcctagccaaatggatggacctggagggcatcatcctgagtgaggtaacacattcacaaaggaactcacacaatatgtactcactgataagtggatattagcccaaaacctaggatacccaagatataagatacaatttcctaaacacatgaaactcaagaaaaatgaagactgaagtgtgaacactatgcccctccttagaagtgggaacaaaacacccttggaaggagttacagagacaaagtttggagctgagatgaaaggatggaccatgtagagactgccttatccagggatccaccccataatcagcatccaaacgctgacaccattgcatacactagcaagattttatcgaaaggacccagatgtagctgtctcttgtgagactatgctggggcctagcaaacacagaagtggatgcccacagtcagctaatggatggattacagggctcccaatggaggagctagagaaagtacccaaggagctaaagggatctgcaaccctataggtggatcaacattatgaactaaccagtattccggagctcttgactctagctgcatatgtatcaaaagatggcctagtcggccatcactggaaagagaggcccattggacacacaaactttatatgccccagaacaggggaatgccagggccaaaaagggggagtgggcgggtaggggagtgggcgggtaggggagtgggggtgggtgggtatgggggacttttggtatagcattggaaatgtaaatgagctaaatacctaataaaaaatggaaagaaaaaaaaaaagaaacctttatatgccccagtacaggggaacgccagggctaaaaagggggagtgggtgggtaggggattgtgggggtgtgtataggggacctttgggatagcattgataatgtaaatgaggaaaatacctaataaaaaaaagagaaaaaaggtgttgtattttatttttattgaaaattaattttaatacaataaattacagttttctcttttttcgtctcctcccagttcctcccaacctcccttttcttctaggtctaatccctttctgtctttcattagaagagcagattcaaatgatagcaactaaacatagcaaaatgtaatataataaaataaaccaaaaacataatgttgtgggtggagaatgcaacctgacagaaggaaaagtaccacagcagcaggcacaagcataagagacacattggttaacacattcaggaatcccacaaaaatactaacctgaatattatagcatatgtacagaggacccaatgcagtctattgtaggctcttgaacagagaggtaagaagaggtatgacctttggcaggaatcatatatgtttgtatgtatgtatgtgtgtgtgtatgtatgtatgtatgtatgcaatttatgtatacatataatttatatatacataaataataatttacataatatgaatattatgtttattacaaataacaatgtaacaatgttatgtataacataatttatatatatttatataatgtaaataatactttgtctatgatttttttctcaaactatttattacataaacatgatttttcaggtttttcctcctggaattttgctgaatgtgattattagcattatgcagtttccggtggcatatttagaacatttttttaacttatagaatcatatcatatttaaattgaaattaattgacttcggcgtttcctactcctatggcctttatagctttcattcttgttgcttacctaagactcctaatactgtactgaataagacaggaagtgtgacctttcttgtctttttcttgattttcatgaaagtgctttgagtttctaatcatttactagaatgctagctctgagtttgattttcattgtcttattatgctgaaatatactctctttaacattatcagtgaccacatttctaaggaaactggacacttgctatcttactagtattcattactatagaaatgtctgcaggtagggttggaatatttagagcaccttcatccttcatttttgaatttgctcttgatcttcttggggaatatacatttaaccataacttttggaggtcatgtttaaacagtcatatcatttatagagaaatatttctgagtacttctccaatcctctagctttcatttagtttccacaactttgtccttaatattgtgtgaccccagtacaggttgttttagatgtcccaactatgactgaataatgacagttccttattcttagtattttaagtagttattcacctttgtgctattcaacacaaactctaataagagtctaatctactcaaagaatcaacagcatgtaactatggaaataaacagaaatatttaaatggaagtttgacaaaacgaccagtcagaaaaataaaattagtatgttctctgctaagacctacagattcctttggcatgtttgatgccagcatttgcagtatcattcctgaattctctcctgaagaacaggcattgatttctaatcaagactgtggttgattactcgagtaagtagtcttaccacagttgcactatgaatgcattggaccttgcaggtcattaatgtagcatgaaaagtttagtgatggataagaaaattattaatttatactctatttagaaaatgcagagagacattttctagcactataaaagacagccagcatggaaagattcctgggtagttaaatgtgtgtttctccatcaaataatatgtatagtgtcttaaataacatggtcttaccatgaagttcacatggggcaattgagaacatgcatgattgtagaaacatgctttctaggattcattgacttattattaattactttagttatatattttccaaatgttagatctcttcccacacttcactccacaagaacccaaccccacacccttcccatcacctctaagagagacttctcctatgcacccacccactcctgcctcacacctctcacatcacccttcaatgaggcaacaatcctccacaaaaccaagagtctcccatcccattgacaccaaataagataatcctcttctacatatgcagctggagccatggaatcacccatctttactctttggttggtggtttaatccctaggaggtataaagcatcttgttagttgacattgttgttcttcccatggggttgcaatccccttcagctcctcagaccttcctctaactcttccatcggggttccccaggcccagtccaatggttgactgtgaggatctgcatctgtcttagggaggttctagaagagtgtctcagaggacagctactgctgtcaacaagcacttcttggcactagcaatagtgtcagggtttggtgtctgctgatgggacggataccaggttgggacagtcactgcatggactttccttcagtctttgctccattctttgtccatgcatttcctttagacaggaacaattctgggttaaagaatttgagatgggtggatggtcctatccctcaactagggaccatgtctatctactagatatgatcttttcgtgttctatctccctagtgttggatattttggctaatgtcatccccattgggtcctaggagcctctcacaaccctggcgtctgggactttctagtggtccccactgtaccctacccctgctacacatttctattcattctcctgatcctctggatttctatcctgtctcttctcataccacaaagctgattctgcctcacctccctttcccaccctcaccaagttccctccatcctctgcctcccatgattattttatttcactttctaaatgcaattgcagcattcacactttggcattccttgttcttaagattcatatgatctgtgagttataccatgggagttctgagattttgggctaatatccatttatcagggagttcaaaccatgtatgccctttggggtctgggttacctcactcaggatgatattttctagtttcatacatttgcttataaatgcataaagtcattgtttttgatagctgagtagtattccactgtgtaaatgtaccatggttttttgtgtacattcttctgttgagggacatcttcgttgttgttgccagtttctggatattacaaataaggatgttataaacataacagtacacatgtactttttatatgttggagcatcttttgcccaatagtgtcctcatgtagaaatttctagtcttctgaataactagaaatcacattggaacgtgatttccaaactggttgtaccagtttccaatccctccaacactgtaggagtatcctgaaacacatggtacagacttatatgtaacttattctctctctctctctctctctctctctctctctctctctctctctctctctctctctctctctctgtctcacacacacacacacacacacacacacacacacacacacacacacacaaacacacacacagaggctacagattccataagataaatcataaacacggaagagggtctcacaaatctaaaaacttcggccttgtgaataccagaaatctcccttacatctgagactgaacaagaaataaaaactcaaggcctgttatcagatccatttatcacaaacaatctccatgaaaattgccacaactaaggatgagggacatctaagttctttctagcatctggctattattattaaggctactatggacatagtggattatgtgttcgtcttatcagttggaacatcttctggatatatgcccaggagaggtatggatggatcctccggtagtagtatgtccaattttctgaggttcttatatcattgagaagagtttttgctatcctaggttttttgttattccagatgaatttgcagattgccctttctaatttgttgaagaattgagttggaattttgatggggattgcattgaatctgtagattgctttcagcaagatagccatttttattatattgatcctgccaatccatgagcatgggagatttttccatcttcggagatcttccttgattttgtccttcagagacttgaagttcttatcatatggatctttcacttccttagtttgagttacaccaaggtattttatattatttgggactactgtgaagggtgttgttcccctaatttcttcctcagcctttttaggatgtttatcggtgggatttcatgtccagaatctgggggaagatcagagattgttgagattgcatgtaatgagcatatgcttttcattctctagagtaggtgatggttctggctgtgagtggttgagagtgtttggtagttagaatctggtagtagaaggtcctcagggaagtggtctgaacactcgaaagctagaggaatttacaataactattcctagatctgtcatcaagaattaacagataactaagtactattattacctggactgcatttagggattattggtgctatttactctgtgccactcaatgcaggtattctattttccacagccaatacgaagaaataaaggaagtgttggaaagatgtgtctcacactcaaaccaaaaaattttctacagaaaagaagattaacataagaacttagatagactttcccttacagcatatggaaataaatatttagaaactagattttagggaatgatggtcaaattaagatattaaaaattgatgattattgtataaatgtgaaaaatctcttttcatacaaatatacaaaaggattctacattgtaacaagttatataaaatcttaaaacaagcttataatctatgttatagatgtgttatcatactctgtaacctgaacatatgcctatattagatacatcacaactatacatggtcatatttagtctgagaaatgagccacagtaaatcagagcaaggaaagagaatctgccagtgacaaataggactaagtgacttaaactttctaatgattaaaaaaaatatatatggcatgtttgtcttaatgaggtttaatggaaaaatgagtccaacctatctattttccaacacaagactttctgagaacataggatatttttctgctacttattattatttatacaaaaggctagctagagccaagtaatcagaaaatgtacattagagtaaaataaaacagaactaaattatgggtaagaaacttctaattctgcagttttctgaagttttgactcttatgaaaaactacttttgcttggtggatgttataataccttattggtattagaagtattgtctctccacatattaaattgtcttcatattaaaataactgtgggccttgtctaggtagtttacagttagttctcatcaaacttaaaataacaatggaaggggagctaaggaagctgaaatggaaggtcagagtgtgagtgtgggcaggagagtacatcaaagaattactggaagtactttatcactcagagaatcagagtcattagtgacaaacaagaccttattgtggaataaaggtgtgataggacatggcccaggaaacagaggtttgtttccttgcatctttaaaacttctcttcccttccctcacatttgatgaacatggtagggctgaatcaaactgatcatccttgctcagagttaatggccaaggaattttgaatgggttctattgtacagaaatatcagcaagagtctttgtatcaaagtattctggtttgaaactgtgactatagttatagcaattcactcatcacatagattttttaattcactacctaggcaacccctttgcaggaaataaataaaccttacttagaggggaatatgattgcccacctctggctcaggattaatgttctgcacctataatttatattcggtgtggtaaggaaagaccctcacaactatatgcaagtggagtttggctactttgctttgagttcttagaaagtcacaggtgcacaccctaccatgagctatctcagatttgcagattacacacacaaacacagacacacacacacacaaacacacacacacactagttcatatttaaactgccttattggctcttgggctgggctcttctatgccttccttggctagtgtgctcttaccttttctccttgctcaatacctctaactcttccctcaacacagttgcttggttacctttactcctacctagataaacacctctaaatctgccctcaacttagttgtccaactgcttttactcctatctcaacatctctaaggacccttgatcctgagaaggtttgaagccccagagtaaggggatggtagaggggtgggatgggagacggtgtgtgggtgggtgggtgaataaccttatagaggcacagaagagtaaagggagggaggttgtggattggagagcttgtggagtggttacctggaagtggggtatcatttgagatgtaaacaaatggaatgattaattaaaaaaaagaaacagaaaaaaagttgaaatgaaaagtggtgttgttataatcccaagccattggctgaatatcagtttcttctgtctctggtccagacctctttctctttttagtagcttatagtctagccctttccaaagcctggagtcagctcagagctggactcctactaggaacttgattgacaaagccctgtgttcagggatgtgtgttaactatcatggcctctgattccttcagtctttgcctgaaaataaaaacattaaggaccaatcagaagaaagatctgatatttagaaatgaaaagcaaaagtgtgctataacaaaggagatctctttcagaactactgtttcatcttgttcttccttcttcttgtatatagcaacaaatgtgtgtgtgtgtgagtgtgtgtgtgtgtgtgtgtgtgtgtgtgtgtgtgtgtgtgtgtgtgttgaaacactttgaaatatctgctcaactgttctaaagaagtatcgggtgatcacaaaaaagtcacaaaaatgagattataatgccaagtaatcaaaacctaagacaatgtaagaaaatgtaatcctttattaacaaatatattctccacagatctgagggaaaaaaattaaatttgtgaactcatgtcttcataatcttcagtcattctttttttccattccactttgatatactgattttttttcatgaaatatttctcccttccctcacatttgatgaacatggtagggctgaatcaaaatgatcatccttgctcagagttaatggccacatcaatattggttagtgtttgctgaacctcacaaggaacagtcatatcaccctgtccgttcagcaagtgcctcttggcaaaggcaacaatgtcagtttgggtgtctggagacagggtagatccccaggtgaggcagtcctcagatggcccatccttcagtctcttctccatttgttgcttctgttcatgtgcattattttgtgtctgtgttaccttacacaggattatattttctagttccatccacttgcctgtgaattccatgaagacattgtttttaatagctgagtagtactctggtgtgtaaatataccacattatatgtatccattcttgggttgagggacaaccaggttgtttccaccttttagctttataaattattctgctgtaagcacggaggatcatgtgtccttgatatatgttggggcattttttgtgtgtgtatatgctcagtagctgtgactacaggtagaactatttccaaatttctgaggaaccaccagactgatttccagagtgtttgtacaacttgcaaccacacaagcaatgcaggagtgtgaattcattgctggacatttgtttttgacaatgagccaccagtgtggctttaaattctgtcattaatgagaaaggcttgcagttctgcttcatctgctagaaaggcaattcacttaagccttcagtgtctgacaagaacaggacaccttgtgctcctcacacaccttcacataagaaatgaagaattttgtcagggacagctttctgctagcatttgagacttcctagtagcttaagtcataatgtttcctaaattatctcccctgtgacacaaagacttctgaaagcaaagaatgataatatttcattctcttttttgtgaccctattaccatcagttgtcttagttcatacttctttcttttcctccattcatagaatttattgcagttggtacacggtttaaaattcaccaacacaccaatagtactaaattaaaccacattatacagtattctccctcgggaaacaaagcatactatgattaccaaagctagatgtcagtctaagatttagaaaaaggaagaatgtgaaactaagaaaaagaaaaagcactcatgatgacaacaaaaaaaatccaaaaagcctgtttttcaacattgactgtctcctctaaattaataaatattattttgacataaactgtattaaaaacaaactagaaactcttcaagtaactaaagataatgctccaaggacattttcacagctacttttgtttgcttatttgcttgtttaaaatgacattacagccaaaattcacatacatttgatgaaatatttccaaagcagtccagaaacacacaatggggttttccattcagtatcttaagagcaaaaataggctatgtttacagtagttaaggcaatcaaattttaaacaaaagcaattaaaaaaggaaaaggaaaaaacaaccgtttttccatgctattcccatagatcttatttgtaagtgcaagacaggaaaacagtgtgcaaaatgcttctgccctgcacactggccatcagaatcacacatggggcttcagcctcttctgctgatacatagtctactaacccactttcccatgtccatcacggcagatcaattctttcagcctgggcctttgttttcagtctataaaatcttttcaggacttagtggacagtgagaaagaaaggaaataggggaaaaaaaagaaaagggaagtaaaaaggagggagagagaaagagtgaactatgacttattgttaaatgatgcattagttattctaaaaacactcagttggttacatgtgaacatctaaatcctgagttggcatgggttctatgcaatttcaagtctggtatgaatgcacactgcacatgcaattttttttgttgtagttttttttaattaattttttattaggtattttcctcatttacatttccaaaactatccaaaatttccccaatacacttccacccccactcctctacccactagagtgaggagaataatgaagccactagagcatgaagccactagagctgcttaacacagttctaccaaagctatgtagatttctacaatccttgttctatccccaacttctgggatttggtctctgtgtgctgcattactggggacattctgcatgatggatcgttttatgtcttttcctgtgtaaaaatttctgagtctttttaggaaaatccttaaattaactttctctggccactatttgaatgtatcctttatgccccgctgatcattaagcacacataaacacatagctccataatgcctttactctaggagttttcttgtgatatataactgtgaatgaacttaaacagtatacttaatgcagagtagagatcaactctgacttgccaggagaataggttacagatttaagatctcttttttatctgcttagaggtctctataaatgtacttaaaatagggagtctgacagtatacattcctgaatgagtaaaactcaataaataaaataaattaaatacattctgacatggtctctgagttcacctatgcatcagtcatgtgtctataagatgtgctctacttggtggcatggactacatctggaacttactagtaatctttctaattactttgttcagagatatctgtgtacttttaagtgctcagagtttcttgtgttcaggacattgttcttgttgtgtatctttatttcaagggtatatatttcaagaagcttctctgatactgtggatcaattaactgactttttctcttcttatactaaggtagcaatttgattaaatatattaaatttatttttatatttgaacataaatttcaattaatattttatcacatttaatcaaattttacataagacactgtaacattaactgtgaaactggaagaaacactaaaaaatgtattaaaagcaatagtgtaatatatgatggcaaaggagacagatactcttctcaatgttactatctttgagtattcacacaggtgattgcttacatacccattagctcttcaaaatgtaccatagctatcatagcttgcaagaaggctctaccctataaaaagtactttcaaccaagaagtcctgtgggattgtcattttaattaattttttttaatttgatttattctctgaatatttgtacatttatacattggttctttatcatatctactctcctttcatatctagtctccccttagaacattttcctccgaatccatgccctccttttaaagtaaatacatcatttatgtataaataccaattactccaaatagtgttatccttctatatttgtggtattaaaacctagaataaagctaccaacatgttcaatctggtagtgaaatagaagagaatggaacagagtttatttttgaagaaaaatgcaaatccttgatagtaaatccttagtgtaatttagagtattcccaaagcctaccaggtatacttgcctaaaaaatggttctgatttagagtttttcttaaaacctcctataatccaattcagataaatactttaggagtatgatttgctgcacaggttttagttactatctcatgtagtcagttgacaaccatagttaacaacaactctgtgtttgcttgtttgatcataactcgctttctttgttcatttttataaagcaagctgttctttccctattcctcatccacaattgtccaattaaagctgatggagatgcctataatcagagccatgatagcatagaagattgtgagaaagttcacagtacaagatatgaggacctttttagaagtcaacatttccttcacctaatagagttattgtagatatactgtgtgaaacatttgatcttgaaatgatatacatacaaaagtctacctatcaccttacatagtacttttagtagcacaaaaatgtcaaatttcaagcatattcaataacatttgtgtgattggaatgctagtcatttgtctgtttctttgagattaaagcaacattttaagtggttaaatgtacattattaggtcccaagtgttgatatattctatgaatttgattctctgtgagtctgagattaggagttttataatttatttttccctagcatatcacaattttctaaatatacctgattccactattacaaggagacagtttgttctgttcaaattttatcccgaaattctcagatactttaacaactttcacacccaacaaaaaggaaacagagaccaagtgacatacttagttcaatgacatatttacttaaacgtatgtattttagacgtttgtgacatcttttgaaagttgcttagattagtacttccacatgagtacttattagcacagactgttctagactgtcttcttacacatttgtatgtctttgacgtatggattttaggataggatctcctgatagttattaaacaggcttgacaaaaataccaagaagaaaaaaagaaaagatgaaacagaaaagctaaaagagcctatgacgacaaattgtagcattttcagaaaaatataaatctcagagagatacattaggtaaagcctgaatatgtcactcctgtagagtctagtggacaaaaatatttaagggctagcttttcaaaaatctctttaggcaggcaattagttgagcaagttccagactgtattggcaaatccttaaagagtgatggtgaggatcaaatcaacagtgtggacagctctgagacaagaggccgcaagacaactgagttctgtccagaccagataggagacccttacaaatgtgtgttgctgtgcctttagaatacctcagttatctacctctctgaagctataaggaacaagactcagtatgttgagatggggagaattgccatataagctgaattcctatttggtttctggattttctaggagatttccaatgatcttctattcaaaatggctaaaaagtttagctcagaaaataagaaccttgagacctgtcacattatcatacttgtcaatttcttccatgtctgccagctacttcatattgttgatgtaacatgcctaccagtcattgacacataaaaataacctgaatgagagcaaggacacactgattaataccctcttattttttgtatgtcatgaattttgttaagcttaggaaattccacaactgtaaacttcacttagtagccagcaaattaaaagtcaataagaactattatgtctaaaatagcttgagtcagggctgaccagcaggcagagctttgaacagctgcatatgagctcattgtgtgctttgtggttatggcacttgtaagctgacactgagaaatatttagggatttatttttcaactccagaaccttatatgtccctgagcaattagtctcagtgtgttccttcaacaaactgtccctatctgactgaaatacgtgttcagctggtttgtgagcaacttctggacccaaataggacatacttccttttgttcatggtggaaatttctgaaaatgacaatttagatacagcaatgggatttctgttttgtgacctctaagtatattgaagatactggaagttagcattgatatgagaagagatgaagtgagtatattctttttcctgtataaataagctaactttgtgtgaaaaaagaggaatgaaatgactctataatgctagtcattgtgaatgtagaaaatttctcactaggtattttgtggagaaggtgagagctgactgaaattttgaatattctaaaaatttagataagataataggaaaatgcataaattgaaaattattctttatagcatgtagcaaacataaggagaatagcaactttcactgtgtcctattatttttgatggaaagttgacaaaatcactcaatttcacatcagtgagtgttgtggttaatcactaggcaataggctttttagctctctatgatcaactagagtgtccaggtccactatcctccaaatcaatcatatagatcccacttttcctcatgtgcacttgtctatttcttttcacaaaatgtttcctaaatcctgtgttggcaaatattaccaggaaaatggattgtatggcagtctataaagtttgtaacacttttggtgagtgtaaatttaggagaaatttgtatatgtggtggggtgttctcatatctcaatgtgtattagaagtcacaaagcaacttgaacaattcagtttttatttctttacaatgtatacaacctggggaccaaatttttggcaacagcctcagttgaatgcaaatttactctctatattatcttcctgccccagtgcactagtcggtacctcacctagaatctccactgagctctacagaagcatcactagcaggggctagcctccagccaggcttcactctaaatctgttttccaaaactgtacataactcactgttgtaggatatttgatcacattatgaacacagatattgtgtaatttactgaaaaaaaaaacactcttttggattatggtgtcactcaacccttagcaaacacccttaatccccttagtgtgcaccaaatacaggatctgactttatttgacttaaacaacatgggaaatcctacttagcctcagccatgatctttcacttttcttttggttttaataccagcttaccatgaaaccctgtcaatatgttttatatatttttaccactttcactgaaacatttctaaagacctagctagggcaaggagtatggaaagacacaaagaaaggaaagccagaattagggcacttgtgatatgaaaatttctttgctgagattaattttgccacacttcataaactttagggcttcagtttacttagccagtataggaagactcacaaaaacagaaagacttcaacccagagtgctaactaggtggaattctgtaaggttatttttggagaaaatcaggtgcagtttggtgctaagttaaacacaaggaccccgcccacccatggtcttttgttcaatattatacaatttaaaacatatgcaacactaatgaacttgagttttactgtaagggaagactgcgggtttgatatggccattaaagccgcacatttaaaagccctgctggtctttcaagatttctttgcagactcaactcaataggaaagcttacaatgctgaatttccctctttagagttttctatgccaggataaaatatatacatgctacatatataattattaaaagaaatgcattaccataatagttattactatacataaatggtatataatgatatgcattaaatgcaggttataggacattttattttaaacaattccaaaacatataatttactgcaatgcacatatatgaagaaggaaaactaaatgggttccacaagtttctgtgcgagtatgttgccacagaccttctgggtccctggtctgtgaggaacaggatttcttaggcagatgggcaaaggggtcggatgaaaatgacaatcagccacacacaagagaggtgttgaatctgaatgtaattttccagtcgagcatcagacttttataatacagaataaattgcagaacaaggcacattgaatttttccaggtgcaaaaggagtgacttcaaaaggaaccagataaatgtataacactagagattagcacagatgcaaggggagtgactacaaagggaatttgtagggaccagataaatgtttacattagagattagcactttctgccaggcaagagttttacacttagagttaatagccccagggtagttaactcttgacacacctcaagaataatgtagtgtcactgaccccaaaattctctaggcctcgttaattcttatctatatctgaagactatccattttcagtatagtatactaatttgctcttggcatggaatgtagtctgtaatacgaatttctatctcagtgagaattttagtctctttctgtaaacagctgagtaaaatggcaagtgctttattagttactgaatgggttaagctccttgctgctatctggaatctaagaacactgtgaaaaggctttagctatgttagaatacaatcttaaaaggcatttactataaggtaatgattaatagagtcacgtgaatctatacaagagactaatgtgggaatggaaaattaattttatggtttatatagattagggagaaaatgccaggcccccgggaagggagtttccttgaaactctttgcttcatgaaccagcttcccagcttttgctttgtcaagctgactccaccagagtgccgtgacagtatgtgtgttcatcacttcagtgcaggtcaagcatgttcattttcacccatatactcaatcatatgccaaaaaatgtgtcctgtttcaaatccagcatctacatattctgtgaaaggaaagaagcacataatatactatactgaagtaatgtttatttcatatgaacaataagctgcagaatttagtcagaactattaatctaaattttttaaaagtgttctaaaaatgttatgaggtaccagtatataagaaattcataggtaatatctaatacttttcaagaacacagcaaatgagatggataaaacagaataacacatcagggaatacagtagagacacctgacatacactttgtctatagtcattgtatatccatgggtgataattagcccgtgttccatttgtgacaatgttttttttttttttttttttttccattttttattaggtatttagctcatttacatttccaatgctacaccaaaagtcccccttacccacccacccccactcccctacccacccactccccccctttggccctggcattcccctgtaccggggcacacaaagtctgcgtgtccaatgggcctctctttccagtgatggccgactaggccatcttttgatacatatgcagctagagtcaagagctcaggggtactggttagttcataatgttgttccacctatagggttgaagatccctttagctccttggatactttctctagctcctccattgggagccctgtgatccatccattagctgactgtgagcatccacttctgtgtttgctaggccccggcatagtctcacaagagacagctacatctgggtcctttcgataaagtcttgctagtatatgcaatggtgtcagcgtttggatgctgattatggggtggatccctggatatggcagtctctacatggtccatcctttcatctcagctccaaactttgtttctgtaactccttcaatgggtgttttgttcccacttctaaggaggggcatagtgtccacacttcagtcttcatttttcttgagtttcatgtgtttaggaaattgtatcttatatcgtgggtatcctaggttttgggctagtatccacttatcagtgagtacatattgtgtgagttcctttgtgattgtgttacctcactcaggatgatgctctccaggtccatccatttggctaggaatttcataaattcattctttttaatagctgagtagtactccattgtgtagatgtaccacattttctgtatccattcctctgttgaggggcatctgggttctttccagtttctggctattataaataaggctgctatgaacatagtggagcatgtgtccttcttaccagttggggcttcttctggatatatgcccaggagaggtattgctggatcctccggtagtactatgtccaattttctgaggaaccgccagacggatttccagagtggttgtacaagcctgcaatcccaccaacaatggaggagtgttcctctttctccacatcctcgccagcatctgctgtcacctgaatttttgatcttagccattctcactggtgtgaggtggaatctcagggttgttttgatttgcatttccctgatgattaaggatgttgaacattttttcaggtgcttctctgccattcggtattcctcaggtgagaattctttgttcagttctgagccccattttttaagggggttatttgattttctgaggtccaccttcttgagttctttatatatgttggatattagtcccctatctgatttaggataggtaaagatcctttcccagtctgttggtggtctttttgtcttatagacagtgtcttttgccttgcagaaactttggagtttcattaggtcccatttgtcaattctcgatcttacagcacaagccattgctgttctgttcaggaatttttcccctgtgcccatatcttcaaggcttttccccactttctcctctataagtttcagtgtctctggttttatgtgaagttccttgatccacttagatttgaccttagtacaaggagataagtatggatcgattcgcattcttctacatgataacaaccagttgtgccagcaccaattgttgaaaatgctgtctttcttccactggatggttttggctcccttgtcgaagatcaagtgaccataggtgtgtgggttcatttctgggtcttcaattctattccattggtccacttgtctgtctctataccagtaccatgcagtttttatcacaattgctctgtagtaaagctttaggtcaggcatggtgattccaccagaggttcttttatccttgagaagagtttttgctatcctcggttttttgttattccagatgaatttgcaaattgctccttctaattcgttgaagaattgagttggaattttaatgggaattgcattgaatctgtagattgcttttggcaagatagccatttttacaatgttggtcctgccaatccatgagcatgggagatctttccatcttctgagatcttctttaatttctttcttcagggacttgaagtttttatcatacagatctttcacttccttcgttagagtcacgccgagatattttatattatttgtggctattgagaagggtgttgtttccctaatttctttctcagcctgtttattctttgtgtagagaaaggccattgacttgtttgagttaattttatatccagctacttcaccgaagctgtttatcaggtttaggagttctctgttggaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggtattggccttgaattcctgatctttccagaacttttatcatgaatgggtgttggatcttgtcaaatgctttttctgcatctaacgagatgatcatgtggtttttgtctttgagtttgtttatataatggattacattgatggattttcgtatattaaaccatccctgcatccctggaataaaacctacttggtcaggatggatgattgctttaatgtgttcttggattcggttagcgagaattttattaaggatttttgcatcgatgttcataagagaaattggtctgaagttctctatctttgttggatctttctgtggtttaggtatcagagtaatagtggcttcataaaatgagttgggtagaataccttctacttctatcttgtgaaaaagtttgtgcagaactggagttagatcttctttgaaggtctgatagaactctgcactaaacccgtctggtcctgggctttttttggctgggagactattaataactgcttctatttctttaggggatatgggactgtttagaaggtcaacttgatcctgattcaactttggtacctggtatctgtccagaaatttgtccatttcgtccaggttttccagttttgttgagtatagccttttgtagaaggatctgatggtgttttggatttcttcaggatctgttgttatgtctcccttttcatttctgattttgttaattaggattttgtccctgtgccctttagtgagtctagctaagggtttatctatcttgttgattttctcaaagaaccaactcctcgtttggttaattctttgaatagttcttcttgtttccacttggttgatttcacccctgagtttgattatttcctgccgtctactcctcttgggtgaatttgcttcctttttttctagcgcttttagatgtgttgtcaagctgctagtatgtgctctctcccgttttttcttgaaggcactcatagctatgagtttccctcttagaaatgctttcattgtgtcccaaaggtttgggtacgttgtggcttcattttcattaaactctaaaaagtctttaatttctttctttattccttccttgaccaaggtatcattgagaagagtgttgttcagtttccatgtgaatgttggctttctgttatttattttgttattgaagatcagccttagtgcatggtgatctgataggatacatgggacaatttcaatatttttgaatctgttgaggcctgatttgtgacctattatgtggtcaattttggagaaggtaccatgaggtgctgagaagaaggtatatccttttgttttagggtaaaatgttctgtagatatctgtcagatccatttgtttcatcacttctgttagtttcagtgtgtccctgtttagtttctgtttccatgatctgtccattggtgaaagtggtgtgttgaagtctcccactattattgtgtgaggcgcaatgtgtgctttgagctttactaaagtttctttagtgaatgtggctgctcttgtatttggagcatagatattcagaattgagagttcctcttggaggattttacctttgatgagaatgaagtgtccctccttgtcttttttgatgactttgggttggaagtcaatcttatcagatattaggatggctactcctgcttgtttcttcataccatttgcttggaaaattgttttccagcctttcattctgaggtagtgtctatctttttctctgagatgagtttcctgtaagcagcaaaatgttgggtcttgtttgtgtagccagtttgttagtctatgtctttttattggcgagttgagaccattgatgttaagagatattaaggaaaagtaattgttgcttcctgttattttagttgttaaagttggcattctgttcttgtggctgtcttcttttaggtttgttgagggattaccttcttgttttttctagggcgttgttcccgttcttgtattggtttttttctgttattatcctttgaagggctggattcgtggagagataatgcgtgaatttggttttgtcgtggaatactttggtttctccctctatgataattgagagtttggctgggtatagtagcctgggctgcagtttgtgttctcttagtgtctgtataacatctgtccaggctcttctggctttcatagtctctggtgaaaaatctggtgtaattctgataggcttgcctttatatgttacttgacctttttcccttactgcttttagtattctatctttatttagtgcatttgatgttctgattattatgtgtcgggaggaatttcttttctggtccagtctatttggagttctgtaggcttcttgtatgttcatatgcatctcattctttagatttgggaagttttcttcaataattttgttgaagatgtttgctggacctttgagttgaaaatcttcattctcatccactcctattatccgtacgtttggtcttcttattgtgtcctggatttcctggatattttgagttaggatctttttgcattttccattttctttgattgttgtgccgatgttctctatggaatcttctgcacctgagattctctcttccatctcttgtattctgttgctgatgctcaaatctatggttccagatttctttcctagggtttctatctctagtgttgcctcgctttgagttttctttattgtgtctacttccctttttaggtctagtatggttttgttcatttccatcacctgtttgtatgttttttcctctttttctgtaaggacttctacctgtttgattgtgttttcctgtttttctttaaggacttgtaactctttagcagtgttctcctgtatttctttaagtgatttattaaagtccttcttgatgtcctctaccatcatcatgagatatgcttttaaatctaggtctaggttctcaggtgtgttggggttccctggactgggcgaagtgggtgtgctgggttctggtgatggtgagtggtcttggttcctgttagtaagattcctccgtttacctttcgccatctggtaatctctggagttagtagttatagttgactctgtttagagattgttcttctggtgattctgttaccgtctatcagcagacctgggagacagattctctcctctgagtttcagtgctcagagcactctctgctggcaagctctcttacagggaaggtgcgcagatatcttgtatttggacctcctcctggccgaagaagaaggcccaaaacaggacctttctcagacagtgtgttgctttggcagttcccaggtggtacagactctcacctaagcagactaaattcctaagttccttggagtcccgggaccaagatggcgaccgctgctgctgtggcttaggccgcctccccagccgggtgggcacctgtcctctggtccggaaggtggccggctgtccccggcccacacagggtgctgcctcagcgcctctgtgcttctgcctgttccagaagctgtcaggttctctggcgcaccctctcacctgttcagactaatttcctaagtttggcgggtctcggaccaagatggcgaccgctgctgctgtggcttaggccgcctccccagccggacgggcacctgtcctaagttcggccgtgacaatgtttgagaatcattgttgcaaatactacaccatatggtataatattctgtactccatcactagccacacaacaaacctattttgttgacattgtcaaattgtgaaacgtattcccgagagtatgagaataccaagaatgaataaactaggttttgtagcccccatatatacatggacataatgaaaaattatcagaccaattagctatctttagatatccatgaaaaaatccagtacagggattgagtcacgtttttaagttaattggcagacaatggggcttcaatgcaatcctcaaaccatccaaacagtttctaatactctaccttgatctatccaacctgtgagtaaggaaccattgatgaaaacagttcctctattgaacacaaagttgctgagctggcaagggaaggtaccaaggcctcacactattactgaggctatgaagtgctcaaaaaaggaatctatcatgacggcacaccaaaagacccaacaaacagctgaaaagagtcagatgcagatatttgcacccaaccaatggaaagaagcagataacccctattgttgaatttaggaaggctaaaagaagctgaggagaagggcaatcctatagaaggactagcagtctcaatctggactcccacgatttctcatacactggactaccaaaaagacaacatacaccagctaatatgcagcccccaacacatatacagtagaggactttcgggtctgtgttcattcaaagacggtgcacctaactctcaagagactggaggcctcagggagtttaaaggccaggtgtggtgggaggtagaggcaaccaagtggagacaaggggtgcagaggaggtgtgggacatggagaagtcagagtggttgggggtggggacagggaatggaaaatggagtgtaaacaataaattaattttctttaaaaaaaaagaaaaaagtttgactaaaaatattgctgagctggtgtctctgtagaacctttacccccaacattacagcatctttgtaatggcaagctaatattcatgttatcaaaacagtaaggtaaaaacaaatacagccataaccccattatcttcaatgttgtattacatgtaaaatatgtgagagtactgatggcacaaaacttatcagagtaactatttaataatgggtttgaattaagaacaagtccacaagatttagccaaactgttactccttggctgacacagagcttaaaactagatgttccctggacctaagagaaaagaaaataatcatctaaaaaataaaaatagaaaaaataaaagtgatgaaatgtctccctaacatattctttctgctatacacataaactagtaccattttcagctttgagcagagaagttttctgcagtatatgggaagaaatgcagaaatcctcagccagatgctgaatagagatgagagactttggaacaaacagccttaaatatgatgtatccattaattccctcctctcaaagctcaaggaaccccacataagttcaggtagagacataacaattgaagagtaacttatacctggtggcactgaggaaatcagttttctccaacacagtgacactaggcaaatcagtcaagtcactccaggataagcctcatgcttaagagtaattggtcaatataaaatggacttttcagtgttttgggtttgtttgtttatttgttttagttttttgaggtatgggtgagttgtaaattgattatagtttggtgggactttttgacatgtttttattttcttgctttagagggttttgttgttttaatagattttggtggggtttgttttttggaaaaaaaataaacttgcttggttgttaggaaaattgaattggaaggacattggggaaggaagaagatcataaaagagaaaaaatggaaaaatgacaaaacatatcaaaaccaaaataacaaaagaaaaatgatcatatggcatacattaattgattttagttttctcatttaaaattaaagagatgttttcatccctgtatgctccccttttactcaaatactaaaactatatatagcatataaaatgtattatttttatataatactgaattgatttcatctccctatttatactcattcatacattttttttgttcctagggtaaaaggttgttattacatttctataacagatgattcatatctaaatatgtactagtttgattttggactaatatttagcctgttgttaagcataagaggaaatatactacattatgtaactgcttctcacctgaaattagtatatttttcagggccgaataaggctacaatactagtgaaagcctaggaggacttaaggaaatagagcaggggatttgtctgaagcatcagccttaattcataatgatcaatcacatttcatcagcattcagtaagtccagagctctctagttttgtaagaccatttgggattggcatggtgtagattgatttgaggcagtttgtagtccatagccaattcctggacggtatctaagagttgagtgaaaatctgctgtgacagataaaaactactacacaaagaaagttaaggtactcaggggaaatcctttatcttttgggtatatgtgatacttttaggtccattggatagtagtttggtttgtagaagtattcccaagattagagaaatcagagaaaaggagggagagagagagagagagagagagagagagagagagagagagagagagagagagagagagagagagagaagtctcagagagacaacccagtctcagaggaaaagacaataagcatagaaatttaagatgttggttgacagaaatatttatctggaatatctatgaaatattatgctactataactaaaatattccatttgactattcttttatttaaagtaacttgctttgtgttgactgtacatagcatttatacacatcttgagaaaactaagaacagtatgagatgagtagcagtaatccctataggaaatagtattattttttgctgatattttcctgggctgtattattttgatccccttttttaagcatcaagtggcaaaagtgatgcaggagagatattaggaaatttctcaatgagcttgcttgtgttgaaagagtggaaagccaaacaccaacttcagaaccataaattaataaactacagcatcatgaaacagtatttcaacattagccatagctaaaaggcactttattcctgcaaaactgaaacaagtgtcctatagaggaaccagagaaaacagggaacaaagagagctcccatacatatgccagctccagtagtgggcagcagtcaataaagtagcaaggtaagaaagaaagactgctatctcttaatatcaatggtctcaactccccaataaaaagacatagactaacagactggctacacaaacaggtcccataattctgctgcttacaggaaacccatctcatggaaaaagacagacactacctcagagtgaaaggctggaaaacaattttccaagcaaatggtctgaagaaacaagctggagtagccattttaatatcggataaaattgacttccaacccaaagttatcaaaaaagacaaggagggacacttcatactcatcaaaggtaaaatcctccaagaggaactcacaattctgaatatctacgctccaaatgcaagggcagccacattcattaaagacactttagtaaagctcaaagcacacgttgcacctcacacaataatagtgggagacttcaacacaccactttcatcaatggacagatcgtggaaacagaaactaaacagggacacagtgaaactaacagaagttatgaaacaaatggacctgacagatatctacagaacattttatcctaaaacaaaaggatataccttcttctcagcacctcacgggaccttctccaaaattgaccatataattggtcacaaaacaggcctcaacagatacaaaaatactgaaattgtcccatgtatcctatcagaccaccatggcctaagactgatcttcaaaaacaacataaataatggaaagccaacattcacggggaaactgaacaacactcttctcaatgataccttggtcaaggaaggaatgaagaaagaaattaaagacttttttgagtttaatgaaaatgaagccacaacgtacccaaacctatgggaaatgcaaatcaaaacaacactgagattccacctcagaccagtcagaatggctaagatcgaaaattcaggtgacagcagatgctggcgtggatgtggagaaagaggaacactcctccattgttggtgggattgcaggcttgtacaaccactctggaaatcagtctggcggttcctcaggaaattggacatagtactaccggaggatccagcaatacctctcctgggcatatatctagaagatgccccaactggtaagaaggacacatgctccactatgttcatagcagccttatttataatagccagaagctggaaagaacccagatgcccctcaacagaggaatggatacagaaaatgtggtacatctacacaatggagtactactcagctattaaaaagaatgaatttatgaaattcctagccaaatggatggacctggagggcatcatcctgagtgagctaacacattcacaaaggaacttacacaatatgtactcactgataagtggatattagccccaaacctaggatacccaagatataaggtacaatttgctaaacacatgaaactcaagaagaatgaagactgaagtgtggacactatgcccctccttagaattgggaacaaaacacccatggaaggagttacagagacaaagtttggagctgaaatgaaaggatggaccatgtagagactgccatatccagggacccaccccataatcagcatccaaacgctgacaccattgcatacactagtaagattttattgaaaggacccagatgtagctgtctcttgtgagactatgccggggcctagcaaacacagaagtgaatgctcacagtcagctaatggatggatcacagggctcccaatggaggagctagagaaagtagccaaggagctaaagggatctgcaaccctataggtggaacaacattatgaactaaccagtaccccggagctcttgactctagctgcatatgtatcaaaagatggcctagccggccatcactggaaagagaggcacattggacttgcaaactttatatgccccagtacaggggaacgccggggccaaaaaggtggagtgggtgggtaggagagtgggggtgggtgggtatgggggacttttgaaatagcattggaaatgtaaatgagctaaatacctaattaaaaaaaatacctaattaaaaaagaaaaaaaaataaagaaagactgcagctcctatggtaagctgagaagagacaagagatgtctagaataaactgcaggaaggaggtgagaaaaactctagttactgagaacacaccgaggaacagctcagaagttcagaatgcatgatagcttagacatgtccatggtaacactaatggtacatggggagacacctgatgagcttcagtttatcatgttttcctataactggaaaagaataatggaaacatgataatacaaacaaatgagtgacgatgaaaatgtgtccaaggaacacaagacacaaatttgtagctatcaagacaaaagatatccagataacttcttgatcttatatcagcatcctgttataggttaacaaactgtgagcaagcaacactattttattttataaattatttttaccatttatcttaaaaagtaatcttataaaaaccttaaagaatcataaatctgaactcatataaaaagtcatttctactttaattcttcagcattcacatattgtcaacattgttttgttaaatcataaacagaagctgaggtcaaaaatcaccccaagaaatcaattatcagagaactgaaatagctgaaggggttagcaaccccatagaaagaatatcaatatcaaccaaccagacccccctccagagcacccagggataaaccaccaaccgaacagtacatatgtagcacaggatagtcttgtcggtcatcaatgagaggagaggcccttggtcatgtgaaggctgaatgagccagggtaggggaatgccaggactggcaggcaggagtggatgggtgggtgagggaacaccctcatagaagcagagtgagaggggatgggatagggggtgtccagggtataggaaactgggaaagcagataacatttgaaatgggactaaagaaaatatccaaaaaacatatacatcatacatgtgtttcataatattggcttatacagttgtcaaaatccatttttattaactctcctctttcaaatatcttatcgtcattctgttgtaaataactattagtactgattttatcaatacttaatgcatctatattattgaaccctgctgttctgtccattgttttaatctcttttaatctccctataccacgtgctgtgaatgaatagacaaagcatgttgaacaggaaagatggtattcctcaatctagatgatcagaaattccctcacaggaaaccagagccacaaagtaataatacaatgggaaatttgctgaggccctataacatacaaagtctatatacaccagtgccatggagcacagtaacagtagcatacctgttaggaagaaaagcctgaccagataaggggatttctcaaatgggtcaggtgttattctgagactagctctaatgttcctgtgatggtatattcagactgaagatctaaaagcattcctcaagtgcagaatttgacaaaaaaacaaatagtatcaacgctattttgacaaaactcctggttttgtatatatcttaattttatttaaagcaaaggaatgctatatttgaaggctcatgcatatccatcgatttgaaaaaaaacaatacaaacaataaaagggaaaggaaggaggatgttagaaagaaacgaaaggaagaaggaaagaattgaaaggaatggaaggaatttataagggaacccatctgagaggaagagtggactattgggaataaggaaggggattgtaggtaactgaaaaacgatgcatagtatgaatgagatcactggaaatttgaactttatgatttgttcaaagactttaaaaattgaaaaattaataagactaaactaaattcatctcgttcaccattctaatttagaatgtgtagttgtgaaaaatcattgaccaatatgaacacagagaaaagatggttatatcatctaaaagtcctagggtacatattatcactgaagaatgtcatggctgaaaactgcagagaagcactgaagtgatgaagatggagctaaactacttactaacttgctctctatggcttactaaactatcttttattaattagaggaccacaggccaaaatgaaggcactatttagagaggcaagcagaaatgtttcagggcaatatatttatggtgtcatgactggaatagcataatttctcagtgtatcacttgcactatgcagggatcctgcttcactagcaagtaatccatttaacagccattctatggtgaggtatacaaaaacagattaaaagaacaacttgagagataaattttctttcctgagttcactgtttaacatcactctagattctataatatccaaatctaaacaaaatgcacaattacctgcctctttaatgaattttatgtaatataatgactataatgtgtaaaaccatgtatatgttagcattcacatcagcaacctaagatccaaattaaattagagattttcaagggctaatttacaaacaaaatagcattaataatttttgctgaaaattgtgtcatggtgctgcctgtgccctggaccacccactgccagaccctacttgccattggggttggaggtgaggtgacaaagaatcaaggcacagattcgagaagcagttaaaaaacaccccagcaagctcatcctatccttgctgcaagctctatcaataccttcgacccatttcccattggtcccaagaaagtgtcccttctaatcagaagttcctgattggctgtcaatgtctgttacagcaatccttgttctctcaggcagtcctaagttagatcctcctgcaggagatgactttggggttgtgtggccaccataacctatgcagaagtggttgcactgttccatatatatttccatccttttggttttactttttgatagcatagtggaagctggggtaatattgctttgacattgttaactccacttcagaggattcccagcataatggattgtgtctgtcttaggttgtcctgtcttccaggaacttatgcatcattgaccaccagcctcaaagagatatcacactggaggcactacatagtggtctcatggatgtctgccaaccaagctttggtcatttcattagggggttgcaatctgaatttttgagagcgttcagcaccttgagggtcaccttatttatggtgcactgcctggagatatgctgcctgagacacttaaacaaaattattattggtatgacaactcccccctcatagtgtatgtgactaatgacgaggggtcaaaaagcctcttaatattgtcccacactgttgccaagattcctacatctagagatagcacagatactctggttatattgaggttagctatgttctcccttaatagcacagatagttaaggaatttgtctgaccaggtaccttcaagatattgaggcatctgttgtcaggcttcagtggtgttatgcacctgattaagggattaggcagattggtgaaacctggggtataaatagagtcctatcccaaccaagggccaaccgttctgctagtatgtcaatctgttgttgtaaaatgtggatgccttgttaaagatgttcatttagtacatcctgtccctgtagtacctcacctaacttagagacaaaagcattaacagtctctgctgtagttgctgtctgggtcaaagcaagaatagctgttgttacactggcaatgccttcagtgaaggccacagtggtggcagctgtaaaaccaaaatcccccttttttcctagtgtaggggttgtgattctgggccatctgggccagtgagtgttagcttgaaagttggtgatatttgccaaaggcatccaaatgctactccccatcagaatatccattgttgaatactgttcagaggttaatcaggagacatttttcattaaaacagttaaggctatctctgacaatggaggtattggtggctagaaagaagatgggacatcagacacagactggagtggatttccatccaacctggattccgatggtcacattcatgcagtcaccccagtgcacaatttctccaacagtttcatatggaaatacaccacactaaagaggcagtcaccatttagaagagtaagggggcataaatcaagacaattagaagggccacataaatccctattgatcataatgtggtcataacagcatctaatgtgatcccaattaaaacaaaaagtaatattggaagcatcatgtgagttaaactttgacatgccaagtgtaaggttagaagacaattttgggtattccctagctaattttatgcctagtgcagtctggcagtgctctcaagagatagaaacttcgaaaaaaaagtggtcatttgaggtgtcctaggacactgaggcagaggtggatgtgatatttttcaggatttttaatcagtaagggaatgtgaagttccatgactgacatgggttatattactgtgaacatcccacatgaccatattgtgtagttgaatacaaggaccgatgaatgagacattggtggtaaagcagagaatttgcacagagggccaggtgccttctaatcactgtgtagtagtgacaagtccaagacaggcaaacacattgaaagagaataaacagggtaagttagggagttaacagccataggcaaataatggggtctagggggaacatggccaccaaatccaagagctgatcagtcttcccaggctaaagaaaaattaataataccagcattatgatatgtttctgcattcggtcttcttctgccttcttaaataccatctggtctgtggctggacaaacatatcttgagggtaccatattgtcacacttgcattctggggggaacaaaaacataactttgcccccttgacattaaaagagtgggtcgttgtctttgaaaggctattgagtcccttcatctaaccaatgggagtgctccattgcaaaaacacccaatgtttgtaagcaaggcccattcctttctcttcaaaatggagaaagttcacattgaacataacctccaccaatgatagatatggatttttttttttttagggttctgtggaggtgactcgtgcaagtgcttccttcaaagatttagtctttttaagattgcttggccgtgatgattataggctatcccaaagaagtgaatgatcctccataagaatatgaaggtgataaatagctgatatgagaaagcagccccattgtcagtcttgagtgcccaaggcactcccattacaaatattactaattttatggccttattagcatgagaagtcttttcacctgccatggccacagtgtatatgaaggcagagtaagtatctatcatcacatgtatttacctaaaattaccaaaggctggataattggtgatatccatttgccagattgcattggtgagtagacatgtatggttaactcctgatctgccaggggcccacaattttgcaagaagtaggcacattccagaggaacttgcaagatatatatagcgttacataagcaattctaacaagagcttatgtaaattgtgagaggaaagtttaaattgctggtttaaattaatattagggcttgttctagcaattctatgcatacagcccattttgccataatcctggtaagacccctcatgggaatacagaatcatggcctgaagggggttccttggatcatgcctttctagtgctgataaagaaagaagcatcataactttctatagaaggttgctagcttaggatgttagtttaaccctgatagaggggctaataggcccctccaagagagtaaagacatgcctcatatccttgtccaaaatagataggaaaggttttagccagttatacttccacacaattgttatagttctaaaagggggtaggattttttatcatagtggataaagccaggggcttaatcttgtcagaattagaaaagctctggaaggcatatggaagcattctctgaatcttttcaggagcaatcttcaagttgaattttcccaagttaagcaacaattgagagaatatctgtactgactagttttgtgtgaacttgacacagctggaattatcacagagaaaggagtttcagttgaggaaacgcctccatgagatataactgtaaggtattttctcaattagtaatcaagggggaaaggccccttgtgagtgggaccatctctgggttgagttctataagagttctataagtcttgagttctataagagagcaggctgagaaagccaggggaagcaagccagtaaagaacatcactccatggtctctgcatcagctcctgcattctgagctgtttgagtttcagtcctgacttcgttggtgataaacagcagtatggaattgtaagctgaataaactttttcctccccaacttgcttcttggtcatgatgtttgtgcaggaatacgaacccttactaagacaatacccttttaagatctggtaggctaaggtgtgcaagcataatatcatccatgtaatggactacaaagacatctctggggactcctgtatggctttagcctgacaaattgctaggctattttcacacctgtggtagaactgctcactgatatattttacctggttaattcatattaggctctcatctattctgaagaaaaatggcatctattctgggaaaccagagggatttggataaaagcaatccttaatatctaagttcatggtacttgggtggaatagcacaagtgagaggcaggcccacttgagtgttcatcactttttccatatgttcattaacagctctcagttcctggagaagcctatatttccctcatttcttctgaatgaaaaaatatgtattattattattattattattattattatacaaagtattatgtatgctgctcaaggattccaaatgactcaaagataattgttccaagactagttccttgaaaacaaaaagcctaggttccaaaatgggccactgatccacccagatgtcagcttcatactgccaggccaaaggtataaggtcaggtaccttgatgtcaattggtgttgggtggacagtcaccattatatttggggggaaatccctgactttgtgacctgtgcagtccagttggtcatgttgcataatattgtcaaaaaaaaaaaacaaaaaacaaaaacaaatacaacaacaacaacaacaacaacaacaacaacaacaacaacaaaaaaaaaaaaaccctaggaagtatggcatccctgtcttctagaatatttttttctcaaagtttgtggggaacatcagccacaacaggtgtcaaagattcctgattgctgttcaagtactgccaacagacaggtcaggtagtcattttggtggcttggtagcttccaaattctgtattgaagggaccagaacagaatctccaatgggggaaccttattgcttaatttttacatttatagtgacatctgcccaggtgtaaagtaaccctttaacgggtataccatctaaatgtacagccatcatcaggatgtttagaaatagcaagttccaaaggactacaggccaagcagtgctcactcttactggcatggctgaggcgtgaactttttgaagtttaaattgtcttcctgcttttgggagagctttagccagtgtaaatttaagctttgacaagggtcagtttgctctcatgttcaataccatactaagcataggaaggacagtattttgtgattgtgttacctcactcaggatgatatcctctagttccacccatttgcctaagaatctcataaatttattggtttaatagctgaatagtactccattgtgtaaatgtaccacattttctgtatcctttcctctgttgaggaaacatctgggttctttccagcttctggctattataaataatgctgctatgaacatagtggagtatgtgtccttattaaatgttggaacatcttctgggtatattcccaggagaggttttgctgttcatcattgggaagagaggctcttggtcttgcaaatattatatgccccagtactgggcaataccagggccaagaagtagaaatgggtgggttggggagtggtgggaggagggtatagggcacttttgggatagtatcttaaatgtaaatgaaaaaatatctaataataataaaaagaacatctttttaaagaagatggtattaataagttctatgcaaaaaaaaacaagagaaatattttttatcaagtttaattgattaatgctttgaagctcacaatattatctggagaaaccaatctgattacaaaatttttattcttcgggaatggacggtggaaaattaatgtatttctgttaagtcaaaaaccaatggagtaggcacaatcaattttaaatgacaaggactacttttcagaggtggaagttggtcactttgctgaataaggcaaatggtaactccaggttttagaatatgattttttcaatacaatggtctattatattgacaggaggtagaacagtgtgatcatccacgggatgaaaaagatacgcatgataaccttctcttctcacatattcagctgcatagatacaaatacaggttcaccagagtagaatgcaagttgatcaatattttctgagtctatgcacttatttcatccttcctcctgctgggtcacttttgagtagatcttcatcatcacgcagactacatactttattcatcccagcaaaattagtatcaaacaaatctttccatgttcttgagcactaaagctgctatggtgagaaagcacttgtccatctttctctttgacctggtggatcaggctgagactcagaaatgttgggcattttccccacacactaccaacacccaagcatgaactagaggaattgtttctcatccttctcacttttaccctacacaaatgctttactttttatttctgatgggtttattatatggaccttgatataggcattctcatgtatacaacatgcatatcatatcacctctctgtacacacaaacacactcagtgattattttactccccacaactattcttcctgatttgacattgactactcctgaattcttattttaaatatttaatcctatgtttttcccttaaacatggggattatctgtgtcaataaaggactgcaagaaacaggagatctaacagccctttttccatttttgaaaatccattccatgaaaaaaatctgtgtgataaattggcctcatccagtaaccttaagcttataaacgcttacatcaacagggtgtgttgacaataactttgctatttctaggatcattgacatttatcactatgaacatccactgctgccatttgacttatatctgtgcaatccctgtgtattatgccagtctctgtgaattcaaatgtggatcagtttttgttgtattttgaaatatttgcttcccaggtgttttccattctcattggatattattacttttctgtctccttttctacaaaatttcctgatgactcaaggcaggtattaaatggagatattgtattaaggattgagtggtccaagttttctaactctctgtatacagttgtgggcccatgtattcatcctcatctaccacaggagttagcgtatctgaaaatagccaagcaactctttcatcaatgaatatagaagaatgtcattaggagtcattttacagttgtttacttggtatagtaataacatttgattcttccatagatttatcatgtctaaaatccatatatgcacagttaacaatattagaaattattgatgacatgagagaaaacttattcacagagttggatcctaaggggagaaacttaggatggctatgttagtagagttttctcttattttatatctcatttctacaatgggatctcaattatagtaattaatatacatgaatgattataaaaaacttaaagtggtgacaaaatagtatcactattttcataatcatttttttaattgttgaggaaaacttatgatctgatgactgaggcaaatgttttattttgacagtaaattttacaaactattaagagatgcttttagttacctacaaataatctattggataatgtataatttattctcttctattatgctttaagtagcagataatattcttactctttttacctaaagcattctagacaaaaagtgaattgaccatttatttttgtccttgaaaaaatctactaaaatactaaaatttattaaaatattgacacagaataaactaatctatatagtacaatgtacttttataatgattacagatatgagtaaaaattctcattagtagcatatacactagcattcagtgcttcacctagagtaaaaaaatattaccagtcttttagtattgctgtgaagacttgcatcctaaaagatcttgtaaatctcaagccacaatcagcatacatcttgttttatgagtgtattttttcagttaattatttaacattgagaaacattctaaagcctaaacgtatcctcccatttatgtaaaatgaactactgtataaatgtacagatctcacaattgaatagtgttactgataaagtgtttttcttcttgtgatcttgaggtgtgaactcttaactctgcccaagaacttaggacgtgctcctcgcctatttaataagaagattacacagacacacagaggcatgacaagacagtaataatttagaaaaaggtgcttgctttctttcttgcttccttccttgctttcagctttccttattagtttcttttgtgtttcttatattcactttttattgtttcatatcattgcatattcattggctatatttttaaatctagatattttgtgaatatcttttctttcaggagaaatgcaatatttcttaaactagatgttatttatctttcttgccacagaggaaaactatatatttcattttcttaatgtattgccctgaggacaatatctagtaagtgttcaaagatctgaaatcagcttgtgtcccttcaagtctaacatttaaaaaagtaccaagaatgtcaggtgttttcttccatatatattaatgaaatcactcttccatacatgacattatttgttgtgtgtttcgctcatggctgcatttttttaataaaaataatagtttcatgtatttatataggtatctgtatagtcactttcaccacattttacatcattattactctttgttctacttaaaccctatattctaaatcctcttactactgtattttctttttgaaagaattttcgacaatttttaaaaattattctacaataatactaaatttatctaatttctatatttcaattctgtatattctgcactcctctttaaaagtcactaactcctcattaaaaattattgttacatatgaacacacataaaacacgtatacatttgattatgcacacaactctacagttggtggaacctaggatatagaactaataaactaggcatgctaatgtcccagactgcagcagtttagactctgagggttaacaattgttactggagtaaaggcctcatgaattaaagctgaatacaacacaagattaagctacatgtggcaaaaacatgtttttaaaaggcatgtgggtaggttaaacatttaattaaatactgacagcaaggaaaaaaagagaaatctcagtaaatactctactatgcactacacctatgaggagcatgaaaacatattctacagttctgtttctgaagaaatctaattcgcaaaaaaattatgatttgttttttattatactgttttgttctattttctttatcctggcctattctcatgagcattaagaattctgctaaatctctccatttcttgatcctcttccccacctttttaaacattgaaaaaatgattaatttttaggaaacatgcataaatacaccatgaaattagattcttattatttactcactgtgatgccgtacaaaatattgtgtaaaagctaagtttaatccgtatttcataaagaaaactattccaggcagtccagtgactaagtaaggtaagacagtgacaaggacatagctagattggtctaccatttaactcaagcacaatctgggaagcagcacaagttcaaggacaaccttaaaaatatgataaaaactttgattttttttcttgatttctttcttttttatttattctctttgcactcccattactgcttctcttccataatcactcctccatgccccctcactttctcttttaagagggtggagtccttcacttggtatccacccacatcagcacatcaagtttatgccagtctaggcacatctactctgccttaggccagacaagataacccagatagtagaacatatcccccacaggaaacagcttttgggatagccaccaatccagttgttgaggacccacatgacaacctatctgcacatctgctacacattatcagaggggaggggaaatgctaggtccagcccatgtatgttctttggttgttggttcagtctctgagagctacagtgttcatgttagatgatgccactatctggttaataaaaaaatttccattgacttttacttgtttttaagtagacttctcttgtagatacctcaaaacacctccatatcctgtaataatatattgcactagccttaagcttgacagttttttatatttatatgatttaacaaggggttatacttaggtattcatgtgaaaaatggccaatatatgaactgagccatacctatagctcatttgatttttttttacattttattaatatatgtataaagtcataaatttctgtccttataagctgtttgactagtttcattatcaaaccatcatgtaaaattgtaggggaaaaataatttaaaatgcatgtttatcacagtttgcattagttattcaaatatttcatttattaaccaaggaattaatcctgaatgctcatgagtagaacctaaagagcttggaaggggacagtgttctgctgattcgtgagttctgatttcacactcagacctgatctacatctacttgtttgactagaagactgtaagtaaaggcataacacagatagcaggatgtgttcattggtttaatgttgacaacaatccataaaaataataatactagaaaaatttaaaaataaatggataattatttcattagtattttggggagagtactcactgcaatttgtacaaccacatgcactatattactcagggttctctataggaaccttgagcttttagattgcagcctgagaaaaattttacattgtatcaatatcaaaggaacatataattactcctatatagttcaagttttctcttcctttcattttatcatgttttgtattattcaaagtttataccaaagatatatatagtcttcatgttagatgatgccactagctagttaataaaaaactttccattggcttttacttgtttttaagtagacttcccttgtagatacctcaaaagacctccaaatcctgtaatagtatactgcacacacacacacacacacacacacacacacacacacacacacatatatataccttgtatatcatgatgataacaacctcaacacaccaacctagcatttttattttttaacgttgaattaatcatgttgtctcacatatgctaagccaccacactttaatgagtgtatttgtgcaaccacttcctaatctgtcctagagtcaccatccgtattacttttcatcaaaagtcaagctaacatttatatgtttgtatgctttaaactccctgcgtttaattattgctttctatatgtacattggttttgggtcctttatttttacattagtatcctactgcagttgcatagatccccatgtacatctggctttccctcccttgtacctacccactgtaaatattttcacatgtaacaggaactctatgtaccctcctcttcattgcttgcatgtttccttacttgattttaatcacctcccgtttggtaactaatttttctttgttctgtttaatagccatgtcaaaaaatcaatattttctacatctttgacattttcctgttcatctattcttcccatgtttatgttcataatttttctccctctcttctgcaagttgatataaatattccagaaatgttaaagtgaagaaaatctgtgtgtgtgtgtatacctatacatatacatatatatattcatctatatgacattatgacatgggggaatcttagtccttaatttgtttttaggaaaaaataagactcagcactgatatctcaagaagaataatacaggaaatttgagaactgattgttttttcaaaatatctaattcaaaggtcaattatcagaatgctatcctttagactatttcatctctactactaaaaaatcttgttaatatggctttattcaaaactcaaactttattcactctaaaagaataaactaaacaatattccagataacagcatcctctaagatacttttctttctttttttgtaaactgtcatccaggattttatgcctgtttgacaattgtggagaaagttttgatatagtcatcattatcatgtcatttctagaccccattatgagtgagaggcatgatatcactatctagtaaaggtgaaacatcaattaattttataattctagtaatagcaaggagagtagcaggattcggctctaatcaaacagttagcttttaccttgctgtgaggattgtttttatatataatccacagataaagcatatgcctagtaattggagctcaataatccattcattttctggtgttgttggaagattttccagtaataggagaatttaaagagggattacaagataggataaacagagaaagagctactgaagtattggaatttaattgtcacagtatgtcagtttagatttagttcataaaaaaaaatgaaatgataggaaagccaatttctgcactaaggaaattgtggaagtctctgaagacttgcaagaagttcacaagggcatccatggaaagtcaagtaaaggaaaccaagtctacctgatatgggcaattatccatttttcataatacttttctttataaacgtaaactgtctaataggatataccttcctaattaaagttcaatatatcaccatgagttcactacttcaactttgaacatttgggaattgtacatataatagtcatataaaggagtaatcttcagaaggagaggtctatagatgtgccttaacttgttgggcatctaactagggaagaaagtgataatggtagtcccaatgaccattaggaataagtgttctcttgaactatgtgtagactttgcaagaactctcttcacaggtacaataatcactccacacccctggagttattgaactgtataaacctccctagatataagctgaggggtgatgtttaaattacaaacatagtgtaatgaacagcatagcagcagaggccagatacatcatttcagacattagtggaatcaattcagatactgaaggagaggataattgaagaaatcaaaatgacataaatggaaagattctgggagatttagtaaagttgatgtatacaaacaatgttagtgtctcatgtgcattctgatatatagaacattaatatatgtgttaaagaccaactgtgacactgaagggcaaactgaggaaaactgcaagtggaaatggcagtggttggtggtaagagcagttgaaggatgttggtccggataccaacaggagctgctgcctgtggcaggcagtgataagatagggtgtgaggggagaagtacaaacatacacacagacaaacacacagaaggttgaaacaagagctgaacttcaacaatttactttttccctcaacagctatttagatcacttaagaaaaaggttttatttattttttattaggtattttcctcatttacatttccaatgctatcccaaaaggtccccatgccctcccccccccactcccctacctacacactcccactttttggcactgggattccccagtactggggcatataaagtttgcttgtccaatgggcctctctttccagtgatggccgactaggccatcttttgatacatatgcagctagagtcaagagccccggggtactggttagttcataatgttgttccatgtataaggttgtagatccctttagctccttgggtactttctctaacttctccattgggggccctgtgatacatccaatagctgactgtgagcatccaataatctctttgctaggccccagcatagtctcacaagagacagatattttctattggaaagaaaattacctcccatccaggagttgcacatgttctagagacagtcactagcaaaatatactttccaaatatacattaaaatatttacacaaatggaaattacgttatatttttcaatgttttatatgaaacctatatctaattaaacaattggaatctatcttcatttgcaaaatcccattttgaccttaaaccagtaattatttagtcattgattaacaaagtttgagcagtcaaaagtctcaagtcaaaagtagcaagttactgtctgtgcttggataacaaccatctgtacttactcagaaacatttcatgtcttacatcttatttttgaagttcagatcagctaagctggctaatcatctgttctctgttcttatactcaataaaaatgtttgttctttattataagcttagtcttttcctggtacacttagaaaacctgctaccttatccctagatcacaagatcagtgaattcacgccaaaattattgcacatgtttagtttgaacaaattacatgcttgtaatgtatgttgaattctcactgtgtgcctttttgtaactcaatttttgccattctatcaggaatggtcacattttttttaaaaaaatctaacttaaaactttctctcaactgtcctaacttcctacctttatactttttaccctaactacacttttatagaattaacctaatccccctaaatattttaaatcaagctaatttcataaaattagaagaagtaaaaatttccataaaatcgctagttcatcttactacctttatgccaagtactttcatcttcatgttgaactgcaagaaacttgtgcaaccagggaggttatcacccaagaaataataacatacagttttaaatattatggttcttccaatgtccacttacaccaaggcaaataaatgaccatggcaaagagaatgagaaatatgggaaagcaccactgtatccacaagcaatcaggggacaaatctccgaagttgtgccataccagagctcacccaatgcagctgaatagaaagttgggtatcatgaggaagctcgttttcacactgtaattgttcctgcttaatgcctgccatatgtacatgaaacaattgatgataatatatcagaaatacccgtgctcaaaatcacctggcttattgaactttgtttctcattaaatgtgaacacactgaattgtgctttgaacaagtgacaatggaatttcaaaaggtatcatgtttatagtctcggcagctctccaattaatttcagaataattgattggaaatctttattagttattttattcgttgacatttcatatgataacccccttcctggggacagctccacaattatccatcaaaactcccctttcccctctctcctttgccatctcagaaagcccactttctgctctaacatatccctacactgggtatcaatcctccacagaagataggcctattcttctgttgatgtcaaataagatcatctgtgtgttggaatggtgtcctgcttctggcacaggagccctcatgtgggtccctgtactacacagaggccagtgacagcaagttcacactctgtaggactgcagactcagaagacttgagaacactttaggggcccatggggtaggctgtagcctggtgctgaaggaaaaaccatggaaatggaagaaggacctctggttagttctccaagtgatgataatatcataagcttagtcacaatggtggcttggcttggaggtgacctggtcgagagagcagggagccctcatgtgggagattagatagggctctttagaggaagatctactcaattttcacctccatacgtcctgataagaaaagactgtctatatttaaaatatatttaggtatacttaattagcagcaatatactcataggttcttttttttttttttaatccatgccttcactaggctggatgatttgataatttctgagtaaggaatgctttccttcttggttattaactctaattgtagaactattggttaccagaagagcattaatacaactactataccctcagatttattgctggtcattgtggttcataggaatcacaaatggaaagggttgtttcttgcttcccttttttcaaatctcatatggtgttatctggtaacatagatttatttctcagggaggtacttttcatgtcagtaagaagagtacatcttaggacaaggtttctccccaacccacccattcccctctgctgaggtatcaagttttcacaggaccatgtgcctctactccctttgttgccagacaagaccatcctctgctacataaggagctggagccatgggttgtttcatgtgtattctcaggttggtggtttagtccctgggagctctgagtgatctggatagttgttattgtagttcttccagtggggttgcaaagtccttcagctcctttaatctcttctctaactccgccatctggatcccggtactcagatatatgattggctctgggcatctgcatctgtatttgtcaggctctgacagagcctcttaagagacagctatatcaggcagaagttagaaagctgttcttggcatcagcaatagtgtttggttttactgtctgtatatgggatggatctccatgtcagtagtctctggatggcctttccttcaatccctgctcaatattttagagaagagcaattctggattaaaatttggagatgagtaggtggccccatccctcaaccagaagacttgcctaacctctggatccagtctctacaggttctctatccccttttatgggtattgtgtcagttgacattgttgtcatatatctaacagtatttaattctaaataacgacttatttgcatttttatctatgtgagccctgttcctatataaactaaacaatggtgctagcaaatgttccctaaggacatgaatattttcagtaccaaatgaatgaggtaacacttaattttccataaccttgaacaattacttaagaaatatgacaatgctcataacactacactacacatttaaacatatgctatactgaaatgtcacaaattttgaaaacagaatatgtgtgaagttttccatattcacatttgtttttctgtttcccaaaatgtacattcaggccttgactgagaaaatcaggtgctatgtcctctaataggtacaatgaacatatgacctagatcaacttccttttttctgctagttgtaacagatattatatgcttctatatgcaaagtttaggtattagaaattctgtctttcctcttgtctgatagaaacaataaccccctacctccaaaataataaaaatgtagtgttttctctatgatttcatgttatctggagtcctacagtaattatattctgaatttaactacatgaataatttcctgtgatcaagttatatattatttggtgtaaagagtagaattttggcttcataaagtattacacacaaacacaaatgtatttacctgtatagaattagagaatggcgtaattgtgggcaaatagaaaattaagaagagacctaaaggacaggatatataatacactaggttaaggaatttgagaaggcagaattgtaagtttgctgtaattattttatgataaaaatattaaactgtatgttgctgtaacatgaaattgtaataattaattatagcaaaattaaaattactattccagtaaaaaaaaatcaattcatgtacccagtggcaatagcaatattttaacttactgtaatttattggaacatgttaaatctatataaaatacaaagtaatacctgagggtccttgcatctgtctgtgaaatgccaacttacaaataaacatgcacatatatattcacaataaaaaagaaaagtagatatatcaatggtaccgtttttggcagaatagtccattttacctaggaatgtgccttttgtctgattacaattaatagtttgaagccctacaaatacagggcatgtaaaatatgtcaatagactggtattgttgctaataatatctcatcccagtgataagtttgagctaaaatactgaagtagaggcatagaacaaaattgattcggttaaatctctgtagccttcaatatagctatcttaggatatttctttccttcactgtttcatcttgaatgaaacattcaaagtttgaataggaaaaatgtcagagcaatcaataaatttgcaaatttgtaagactttaagcatactttctgtggttaaaaacaataaacaattcattgcggagaggaagcctttagtgtcttattactatagcactgttctcctgatacgcacatagtgggaatcataatttatgttgagagctttagggtgttaaaattggacttccatataacccatgctgtcatataaaacacattaaaattagtttatgaattttatattagttgaacactgttttctttatgttatttattcaagacctcttaaggttaattgtaattcctacatatcattcatgaaatatagttcagcagtaatattagtatagaccttaatgctttctttactctatgtaagtacatatactttaatttatgtttaattaatgtattatatgacaactatatttcaaagcaaaaaaatatataaaaataaatggagaaacttcaggaagtactgtagtatagattacaactatgaagattttgaaaacatattctacgaacagttccgtgttctgaagaaatttaatttgcaacactcatgatttgttttgtgttgttttgttttatctttatcctaaaatattctcatgagcactcatagtcttactaaatgtctccatttcttgattatcttcccgaccctttctgaacattgcagcaaatgaataatttttaggaatatgtataaatataccatgaaaatgggtttttgttatttactcacaatgctgcagtacaaattattgtgtaaaagctaatttttattcttatttcatgaaaaagactattcaaagcagtccacactagggttaaacagggaaaatgacatagttagtttggtctattgtttgattcaactggagcctgggaatcagcacaaattcagggccaggcttcaaaacatgaggagatctttgttttttttcttgatttatttcctttttatattattatctttgcattctcatcaatgttcctcttccagaatatctcctcaatgtctccttgctttctcctctaagaagttggaatcctcccttttgtatcctctcacctcagcacgtcaagtctatgccagaataggcatatacactcccactaaggtaagacaagataacccagcgagtaaaacatatcccacacaggaaacatcttttgggatagcctccacactagttgttcagtacctacatgacaacttatctgaacatctgctacatataatcagatgggaggagaaaagctgagttggaaacatgtatgttcttggctagtggatcagtctctgagagccccagagttcatgttaaatgatgctgttggtcattctgtggagttcctatcccctcaatgcaccacaatccttcttccaactcttccataatagttcccaagttccatccactatttagctataggtatcagcatctgtcagagtcagcttcagtgtggccaacattgctagacactagtctgcaagcataagggagtatcattaatagtgctagtgattagtgcttacaggtgagatgtatctctcactgggtgggatattgcttggccattttctcattctcaattccagtcccatgactgtatttctactagacagcataaattttggattgacagttttgtgggtgggtttgtatccctatcagtcaactgtttctggcctgactacagaaggtgagtactttaggttgcatatcctctatgttagaagtcatagcaaaggtcatccccattgattcttgggcaactcccctatcttaggtatcaatatgcccccctacctctccaacactaccaggaacatatttccattcattctcctgatcatctggccatctttcctgtatatctcctcacttgaccctgacactccctcccttcattttcatcttgattccctctcctaaaccatttactccatctatctgcttcctgtgtgcattttattccctatctaagtgacaatcgcacatccttacttaggtctttttcttgtttagcttctttgtgtctgtgcactgtagcatgggtttcttatttttttatagttaatatcccctgacaagtgagtacatatatccatgtccctttgagtctcagttacctcactcatcaggtaatattgatttcaaagtatcccataaatttgtgtgtaatgagccttcattttttttttttggaaaggcagaaggcatggtctttattatgcatcacggcatcagtatatattttgttcagtgtctgtgtatcagaaaacctacgtggcaatgagttcttcattctgtgctcatcaaaagccaaagtgaatattaagaaacctggactctggtgtgatcgtttgtcctcagcatcccgtgtcccactctcccttacagggttcaaggcggaggccccaggaggaagagaggtgactggtggtagacagggcctgtgtggctcgccagcctcatagagcctcctgctcctagactggcagggaactgtgggcagttgccagcctgtttggttgggagggtggaagcttactactggactgcgtcgtgaaggagactgttcataggaatctttaagtccagatctggctgcccgtctagaatacccatgttctcggcagctctattttcctttgcatctggcaagtaggctcaagtcctcacttttactgtgaatgaaactcggggctgggattgccatccctcagggcccgaggttgatgaagggaaagtctgtaacaggatgcatttctgcatcctgctacagaaaatgtcccacccaaactgacagccttctgggactggaagttgggagcaaagcctggttttcgtgggtggcagggaccagcaggggtgggcagcacccgcagctctcagccgaagcagtgaacaattcatactaactgaaaaatatttccctgacgtacttcagcacgccttcctcctccttctcctcctccgggcttctgctacagggagagtctgaaccttctggtccccggggagggctgaggcctggatcaagggagctgatcctgctgtcttcttcctcactgctgctccttgttttggtaaaatagtatgtagatgacttttaggaacatctgaatcataattccctttagtttcattatttctctgttaatttttgtttaggtgactgctgagaaccagcctcaaccgttttggggttctcaagaataggaagattggatccataccaaatcagaatctcaagcacgatggcactgacttggtgttctaaagctcctgtctaagaaagcttttccgggtcattattttcttcaaaccaattaattttcctgacattcttatctaactatacaaccaaatcacacaaggtacataaaagtcacaattcagtgcctgaaaaaaccaaagcaagttatacattaacatttgactcccagaaaagccatcaaaccaaagctcttctgggcatgagcatgtgcttacagcattagcattaacattatacaagtcaaaataatattaatattttagcttatcttaaattagcaaaatctctttattaatctcatccaaatatgtatttcaacagtgacctgtccagcaggtccagttatttgagggtctcgaggggaccttctcctaagaaccaaatggggggattgagagagatgaggaacaagtgcaagaacgacatggaaatattctgagtggcattaaagtcccactgtattagcaaggttcaaggtttaaatgcacaagcaaaaggggaagtacttctcagcagaagggatggggcagcagaaatttttcttttggcaactacatggggaagcaggaacttggtggtatcagggtatatcttgaggtcaggacatccagcactgacttagggctggaacaatctgtggttgttctcagagcagtgggtcagttgcccgcttttgacccccttttcttctcgggggagaggcccaaatcagagaataggacaatagtgttgtcttaatagctcccaacatctcccctgttttaatatttttataaaggcatattgtataataaatttgtagccacgtttttaatgaccacctaaacatctgtttgctcactgggtgattctctaaaaccacgaaggacacaaggacaagtcatctatgaggcttgaattaatggttccagtctgttgggtataacctgggctagccaagggatttaggaatgaagcaagctccgtgggtagagatagaggtctgatccccagtgtgcaatgttagaggccatgtacaggattgactctcaggcccacagatttttactcagagtaaccctgacctgctccagtgccttttttcctgggggaaggagcctagagcactcaacattcatgcaatcagacatgcctctcagagacagtctaacagcttccaaactaatctctgtgtagtacttagtctcacaactctcacaggcgacagcttcaggctccaatttttctatgtgtctagcctgggatgactgtttagtttccaatgtggcgaaaatgtatattaccatgtcggaagcacagactacagcaatctataaatgattcgtggcatgagactgatggccaaatttagggagaggggaatgatcttacttaagcattttatggaaatcgagtctctttcctgagatgagggtgatgaagcagcatctaaatctgactcttctccagtaacctgcttgttatcgccaacgtctagccaatggtaatgaactgaaacagatgcacttgaaatagataaatcaatttgagatttaacaaattgggtcaatttctgaaatgcccaaggaccaaaggaaatcaataataggagtaccaataggggccccaaaggggagggcaacaaggtcgaaagccagggggagattgaaaaccaattttgataccatagctcttgttctctttctctttttcttttttctaaactggcagtaaccttggcaatgctatctttaactaatcgacacaagggctgcgattctggtccaggtcccagttccagcagcacccaggccaagaaggaccacaagggtcacctttgagataggctctctttagtggcgggatggcaaggaggcacctcaatcccaaaacttcagtaagtcatctgactcatgaaaactaaattttggaaaaagctgaaataagacacaataatctctattatttataaaatcttgtataataatgtactgtataaggcccttggaacatgcaaaataggtatcattttgggcaagaagataagaaaacccatttttatttttttttttccattttttattaggtatttagctcatttacatttccaatgctataccaacagtcccccatacccacccacccccactcccctacccacccactccccctttttggccctggcgttcccctgtactggggcatataaagtttgcgtgtccaatgggcctctctttccagtgatggccgactaggccatcttttgatacatatgcagctagagtcaagagctccggggtactggttagttcctaatgttccacctatagggttgcagagctggttggcatctgaaaacagggtaaaatttccaaataaggctatgccctcataaaaggctggggaagcagaaaagcacatccaacaatcttcatattctgttgcattatcactttgtgtcttatccaacaaggctaaagcagaatcattcaatatagaccacagtaaatcagtgcaagaggggggaccccacagggaaagtggactgaaatagggtcgttgcatgccctggggcagaaacagggggcaggtacctggaagtctgggattgtttggggatttagggtgatgtaattgagaattaggtcctatggatgctttatgattgttaggggtggttttaagaagctgaaccttaaaggtcaggccattatcatacttatcttgatccaatctgaggcaagagggtgagaacttttccaagcctctaagttcttccccatagattcacaggaagactttaaccacaaagggttgaacagttccagtattgttttctttgtctgaccatgttagcagtctggagctttgtaaagtgtcctgtgtttgacctatgccttttaaatgagtggcagtgggctgtaagggacaggctgtgggccaatgtgttgaggaaattactttcacatctgccctggtatccaggagcccttaaaactgtttgccctctagaaacaaagtcagcatgcgccgtgaatcagttattttccgtacccagtagacttctgaggatcccggggaggatggttcttgctcctctttcatataaggaaaatagccgaatagtgggagtggtagggcttgggctatgtgctctccagccctaagggaagtggtccctgtgtgactgtgactaagatttttaactctccatggttgtcggtatcaaccactgtaggagtcaatgttaggccttgtaaaactctggacactcagccgatgacaagaaacttcttttggggagggggtccaagttcacttgtttcgatgaccacagttccctcctcaggagttataatccaggtagtggaggaacacaggtccaatcctttgttccctgccgtggccctacacaatctcccgtgggggttagggggttgtctacagttgtcatcaggggagacgtgccctgcaggggggccctctggccatttcagtggaccgcagggagtgggtggctgttgatatcaaacttagatctgcaatctttgcccaatggaggcctctcttgtacttagggcaaagaccgtgggggggggttgttgggtaacaggcatagttgagagtggggttctctgtctttgtgtagggcatcctctagcaaaatatccaggttggttgcatctgtagcaagtttttttctcctttatttatttgtttctgagagggacctttgcgaccagtttgaggatttttagagatgggaccttgaaggttccccatgagggctttttgtagactctgaatctctagactgacgtcttgtagctccttttgaagcactagaacatctttaagattggtgatctgagtctgaagttctcttttagtttgaagtaatcgctgaatggatgaaggggccagcaatacaggccgaggattaggctgaggattagggggagaggggggcaaataaggaggagggtggaaattgaagggctcgatggtaagataggcacggagcctggaaccatagtggtctcgttcatatttaaaggcttcctcatccaattctgtctctgaggcaggattgaggggttcatctgacaactccttatacaaaatggggtaaattctttttggtctaacagggggttgagcagtagccgcttttctagaatctaatctaatttggggagaaagagggagaggcagggagtccttagggactggggcatctataatcgatgatggccaaaactgaagattcaccagtggcttagtttcgcttttgtgattcagcaattgggagttttctaaaaattcttcagtaaggactaggaggcaatgtcttctccaccctcttctgcctgtttaaggagatctctgacgattccccaatagctaaaaaaggactcagggatatcttctccttgttttattaaagtattgatatctttgcctatttcagggccattcaatgccagccatggacatctctcacccaccaaacaaacaaaaaaaattattaaatcctttttcttaactcttatccctctctcctaaaaagaccccttcatctcttgaatataaactgtctctttggacagaacattccccatggtgaatgggacaacaactgaatgcacaggcttacctctcgatgtccacaacactaaagcgaagtggctgggaactgtctcactgtctgtgtggtacttctctaatccattttccggaggttggccgtacctcgtgccccccttctggtgccacttgacccgtccagcaggtccagttattcgagggtctcgaggagacattctcctaagaacaacatggggggataaagagagatgaagaccaaatgcaagaatgacagggaaacattctgagtggcatcaaggtcccactgtattaaaaaggctcaacctttaaatgcacaaacaaaaggggaaaaattctcagcaggagtaatggggcagtggaaatgcaactcagcaggagggatggggcaatggaaatgcacctcagcaggagggatggggcagcgaaaatttttcttttggcgactacatggggaagcaggtacttggtggatcagggtacatcttgaggtcaggacatccagcgctgactcagggctggaacaatctgtggtttttcccaaaaaacacagtaaatgaagtcagtctccacatatagaacctttcttcccattatgcttgggatgactgcaggaatggccaggggctgagcaatttgtttctatagatataaaaaccttttccttctctagtagtgtcatcaatccctttctcagaaatttttacctaagttgtatttgagaacaattattgtattgaaaaaggggaaagagataagcatagaagaaaggacaatgtcatctgtccacctgaaacccagagaaacattattccggtttacagagttctcacagctgaaagtgaatcatgcaaccatgtatgaaaccatgttgtaccaatcagatgacctattgattaaagtgagacataggcttagattttgcaaaacctactttaacaagatttctaaaacacattgagcccccttctagcccaaaatccaaagttagggaagaaaagatgttacatacttctagggcatgagggcttgtttagaagcagttctctgagggccattccaacctctgttatcaggttactaacagtctagttcaaatgtgtcaccaaagatgagttagcagcagcagcaccatacagaaacagcagaaactgtaaggcttcagctaaatcatgagtcagttgaagccaccagaaccagatggaaggcaaggagaagttctctgctaaacttcactctacaaatcaatacaagtgaaacacaatatcaaggaaaggttgcaaggataactatgggtgtgacctattcctgtcaattgggtactacttatactttttccaaatataacatgtcctctcatgtatatttcttcaggcaaaaatcacatgactctgcatcagcataacttcacatgagtctgcttcagcaaaatatcacctgaaccttcatcacatgacacaaccagaaaattctatttcagtggagagctggagtctcccactattgaagtgtggagttcaatgtgtgctttcatttttagcaatgcttcttttacaaatgtggatgccatttctgtttggagcatagatgttataaattgagatatcatcttgttagatctttcctttttatgtgttatgaagagtgctgccaggcttcttttgattaattttggttgaaggtatattctaatatatattagaatggctactttagcttgcttcttgagtccactcacttggaaaaaattgccccacatcttactctgaagtagtgtctttctcttttttcctaccactctaatgctatgacttttcatggtatccctgattcactgaatattttgtgccaagaattttttttttagatttaacaatttttgactgatgtatcattttcttacattctatcttgtatgcctaagattctttcttctgtatccagtaatctgtttgtgactcttgcatatgttgttcctattcacttacctatgttttccatctcaaaggttccctcagtttttcttttctttactgtttctatgtccagtttcaggtcattcacagtcttacttattttgttaactggtttaattgtattttcctgtataactttaagggatttgtttgtttcacctttaaggatctgtacctgttttattttatttttctgtttttttttaagagattgttttatttttgtctttaaagacctctatcacattaataagattggctttatggtgattttcttgtgcttcatttgagttaggatttccagggcttgctgtagaaagttggttgtgctctgaaggctttatattacctttgtcttgttctctgtgttctgagggtgtttagccatctgaatggctttcatcactggttagtcctgttgtattaggtatggggattgagcttaacctctctagtcctggtgtggcagtcctctgatgtgtatccatgggtgtatgtttcctgatcaccaggtttgaatggttcatgatctcttggtctgatgaaggtggatggagaaatggcaggagtgtggaggtccatcagggataccaaactgctcagtgaagcttggggttcccagtgaattcagtgggcaagtaagatgagtgggtgaagataatgtaacctatacacttcaggatctgcaggactgatgaaagtggttgaaaagggcagtagggtaataacagtatatccacactctttttgattcaagtggaatgaatatgtttgccatgtgatttctgagtatcatataaactagcaaattatgaacataataaataagaataaaataacaaaatatctctgtataatattcagccaacaagaatatgttttcagagtatgtacaatacattatttattaagttgatttaaaaaaagacaacagcttgaaaagagtacttcaactatgtcaaagaatataagcctgttttctgccccaatatggggaatgccaaggccaagaagtgggagtgagtgggtaggggagcatggcggggggagggtgtagggaacttttgggatagcatttgaaacgtaaatgaagaaaatacctaattaaaaatttaaaaaaataatataaacctgtatttgctattaatagaactgcaaatattatcacttcctacacaattaggacatgacaaaattccaaatgaaactgacatacagtatctggtctaaatgaatgaaagaatacattctaggagcaagggccaatcataaagagagtcattaatagatttaatagattctggacacatccaatctatcaattgaataaatgaagattaaggatcataagactagtatacatgtataaaagcactgagaagaggtacaaaggtctaagcaaatagcatcatcacaaagtaataatcaggtaaaatagggttttctttatttaatagaatagcaccttcctttcattgcatggccttaacttaaacaactaggtagacatttgcttaagtagtctgtcattgcatccatctgcaatgacagacacagaaaccctaccaatattttttcagccaaatccatttccaattttcaaattatttaaattacagaaagctatctaaaggcaatacatggtgttctgcaagaaaatggttttgatctcatgaacatatatcaactttagtaaaattttatgaattataaaaaaataaatacataaaaagaaaatggtagaatatcctttggtgtcctccatttctaaattttaggaactgctgatttaatattacttttcaaatgttctctgatctttatctaaaggaatgacttttataggattaatacatcattctttacagaaaatatcaatttgtttacttatatagagtggtctgttgttattttttcttacagaagttggtattcccataataggaaaatttcgtagaagaggataatgcagaagcattctctgaggattgaagtataacccaaagaaatttagaacgtatccaatgcaaatgtataggtaaagtttctgaggcaagattgaactgcgggtgacttctgtactgttttataaaaaggaatagaagccaagaatatatttgttgtaggtacagtatgctgtggggaaaggatttgcctctgtgggtccatgcagacgcatcactagacactgaggtaccagcacaatgatggtatagtatagaatagagtttaatcagggcatgggaactggagttgagggagtagaggcagggaaagggagagaaagagagagagagagagagagagagagagagagagagagagagagagagagagagagagagagaattaaaggcagaaagactggccatgagcacatgaaaagtgaagatggaggggaatggagagagcaaaggataaggaataaggaaggagcaggagcaagaggggaggggagtgagcaagagagaaagagagcaagagttgaggactggcaagtaaactattttatagtgagtcgggcataccttgcctttgcccgataactgtggtgcagagcataaacaaaatgccaatgtttccctattttggtttaattaaaaaggagaaactaagaaaggatgatggtcaagtaggaatatggtctttgtgtacttgacctacttcctgctgactttgatgcaaggtatccctgggaaacctaagaaagtgagtatggaaatgttggtccagtcttaggagacttgtctgattccttgatgtccagggtgtatagaaccatctgtggctatataagaaggaacaggttcagtagtagagacatctgtggcttgcttctctggagctgtcctgaatataatgaacacctggacttgacaagatgctgactcatgtgcatatatatgataggttgagaatgaatttaagtaatttggtaattttcttcctaaggtatgtatatatttgaaatcctgaagtcttggtggttgtgagtgagatgagtcccaattctaggaccaggagcaggatccaaccctctagaataggaactcaggctactgattgccagatgttcttatctggatcaaatctttatggtctgtgagagagaagtctgagtgggtttcctgtagcatataaatttagaaagtgataaatttgttagcaacatgaatagtctttaagataatcttagagaagataaaaaccttcatgcagcagaagaaggaagaagcaattttttctgtttgtctaggagcctaaatatccacaaatttagtatatcaaggaaaaaattaagcttacattttaaatacaaagtgtaggactctgatacgcagcctgttttctgtttgagatagatttaaacacaggagacgcagcagataactgcaagggaccgaagccatttgcatgctgcactactagacaccaggctcctgatacaaggtctcagctctccataattctgtggctatcagtcacataaggtaatgccccaagcccctccataggtagcagatgtgactacagatcacatagcctaaaggaagatctccattttaatgaagaatctaaaatcctgaagggcttagccaattaagctctccttctcagacactgaaaaagatatttaacatcaggcctgcccttagaaactgggttaaggtttcactcatcacaactctcccccatgccaataaatgcctgaaaaccctggacagtgtcttctcatttaggatccaacatgttggagcaatggagcagatctttctctaaagagccacatctaacctcccacaggaagattcactgcactatctgccaggtcagctgccttaccaagcttggaaactctcatccctggagaacctgctctcctcctctccttttccatttggcctcaagctgaagcctgcccatggacccctgcaacattcaaagctctttggagacattgagctggctcctgacagttcccctgtggacctcagaatgtgcctcctcaagcgctgagcatggtcatgcagcttctcacagccccatgcccacccagcattcctgtgcggtgtccacaatcaaacttcctgtgttttgcatcacccaggagcctgagcactgggctggatgtgggccacaatgttaacccacaacaaagaaaattcaaattcttgaccttgcaaatatgatatttgatcatacagtttagcaacagaaaaaccttatgacaatcatgggaaatgtatatttgaatttgtgattatacaggtggattgcttactggaatgtttactggggttagcatattttataagaagactaatggttaatgttaggagagtggcatagcaaggagaagaaatatgaaccctttagtcactgggaactgaatttagttaaggataacataaagttacacttgtgaaagcttacatctgaacttgtgtatcatttattgtgaagtctgtataaaatctggcagtcttaacaagttaatgaatttactaatgagcaaataaggttgcttaccattgggtaaggaacaagttctgtttttctacagctatcaagctagttattttagcagtacatctactcagaaatctgtgaagattaaattataatctttaggtcatatattaattaaaatggcatgttcatctatggtccaataactaagcaatccccaggtccctgttctctccatggcaactagggaagaatcagactggctatcaagccctgaaaacaaaaatatacttttttcctcgctcggtccccctccctccatagagtagatacatgtgaaatgacaagcaacacacattgtcttaggcaatataagacatttgactctcagggtatcttgtttgtccacagagtagtccaagccctggcagtgagaaggacaatggagtggtgtttcttaatggttgtcataccaccatccaagtagaaacttttccctgtacccaatatcttctaagagaccttggtagaggggtaactgttaggctatagtagtctctatctgtcataatcttaaaggttattacaaaacagcttttcttcccggtatccagcaacaatttattatgcgaatcagtataggaaagcttaggttttggctatgatcttctccagcagaatctttttttttttctcatgccacttactcatagctgaagaggtggattaaagactgcatcccaagttaagtcacagttactgtgcactccttgattatctgaagataacaaagggtgtgatttggacccaaatcttataaagaaaagccctatgatgaaatgacactgtgaaatccatctaacagatatcaccatctttacccagctgagaggggagcatcgtctgatagccagaactgagtggaatgggataatttcctgtgagtgactctgcgagaggattctaatccggagtgggaaaaacaagacctcctgtttctcttttatggccaaggcaagctaggatgacaagatctttggggggaaagtctcttggtttactaaaaacctgtactgctcccaatcgtgaatgaactgtgttgggatggtgggcttccactttgcaaatgtaatgacagaataattaggagatgaggcagaggtggtctttgggcagagttgattgcccttatgctttccacatctggggaatgtaagctagtgtacttcatctggggtttgtcttattcttctagatcagttccttgcctggatccagaagttaagttccttttcttattcccctcaaataaatgatacttagcttgaaaaacgctgtgctctgaatagatgatgaaaagttcagccctagaaccacttccatgttaatgaagcatttcttaataagtcaacactactctcaggaaaccacaaagcaatatagacaaaggcatgcttcttctcctcacccaaagaaggtactagacaacgtgggttcccatgacatatctgtaagactctctgtgctagactttcctcagtataagcatctcattctggctacaaggtcccccaacgtttccctacttctgcccaactcttctaaggctcttggcttatgagtttattatttttaacattgaaaagaaagttctgcattaatggcttccacttctagccatttagatcttagatgctaggagagtgggctgagggcatggatcaattcacagttagctgttctggccattggggacacacttgatcataactttcagccccactccatttttgtctgtttcaaaggcttcaactgccttgtccagagggaatttgtgggtaactaagggcttttttttctttttctttttttttccatttttattaggtatttagctcatttacatttccaatgctataccaaaaatcccccataccccccccactcccctacccacccactccccgtttttggccctggcattcccctgtactggggcatataaagtttgcaagtccaatgggcctctcattgcagtgatggccgactaggccatctttagatacatatgcagctagagacaagagctccagggtactgcttagttcatattgttgttccacctatagggttgcagttccttttagttccttgggtgctttctctagttcctccattgggggctctgtggtccattcaatagctgactgtgagcatccacttctgtgtttgctaggccctggcatagtctcacaagagacagcaatatctgggtccctttagcaaaatcttcctagtgtatgcaatggtgtcagcgtttggaagctgatcatgggatggatctctggatatggcaatcactagatggtccatcctttcatcacacttccaaattttgtctctgtaactcattccatgggtgttttgtttcctattctaagaagggtcaaagtgtcgacactttggtcttcgttctcttgagtttaatgttttcagcaaattatatcttatatcttgggtatcctaagtttctgggctaatatccacttatcagtgagtacatattgtgagagttcctttgtgattgggttacctcactcaggatgatgcccttcacgtccatccatttggctaggaatttcataaattcattctttttaatagcagagtagtactccactgtgtaaatgtaccacattttctgtatccattcctctgatgaggggcatcttggttctttccagcatctggctattataaataaggctgctaggaacatagtagatcatgtgtccttcttatcggttggggcatcttctggatatatgcccagaagaggtattgatggatcttccggtagtactatgtccaattttctgaggaaccgccagactgatttccagagtggttgtacaagcttgcaatcccaccaaaaatggaggaatgttcctctttctagacatccttgccagcatctgctgtcacctgaatttttcatcttagccattctgactggtgtgaggtggaatctcagggttgtttttatttgcatttccctgatgattaaggatgttgaacattttttcaggtgcttctctgccattcggtattcctcgggtgagaaatctttgttcagttctgagccccatttttaatggggttatttgattttatggagtctagcttcttgagttctttatatatattggatattagtcccctgtccaatttgggataggtaaagatcctttcccgatctgttggtggtctttttgtcttattgatggtgtcttttgccttgcagaagctttacaattttatgaggtcccatttatcgattctcgatcttacagcacaagccattgctgttctattcaggaatttttcccctgtacccatatcttcgaggcttttccccactttctcctctataagtttcagtgtctctggttttatgtggagttccttaatccacttagatttgaccttagtacaaggagatagtactggatcaattcgaaatcttctacatgataacagccagttgtgccagcaccatttgttgaaaatgctgtcttttttccactggatggttttagctcccttgtcaaagatcaagtgaccataagtgtgtgggttcatctctgggtgttcaattctgttccattggtctacttgtctgtcactataccagtaccatgcagtttttatcacaattgctctgtagtacatctttaggtcgggcatggtgattccaccagaggttcttttatccttgagaagagtttttgctatcctaggttttttgttattccagatgaatgtgccgattgccctttctaattcgttgaagaattgagttggaattttgatggggattgcactgaatctgtagattgcttttggcaagatagccatttttactatattggtcctgccaatccatgagcatgggagatctttccatcttctgagatcttccttaatttctttcttcagagacttgaagttcttgtcatagagatctttcacttccttagttagagtcacggctaggtattttatataatttgtggctattgagaagggtgttgtttccctaatttctttctcagcctgtttgtcctttgtgtagagaaaggccattgacttgtttgagttaattttatatccagctacttcactgaagctgtttatcaggcttaggagttctctggtggaaattttagggtcatgtatatatactatcatatcatcttcaaaaagtgataatttgacttcttcctttccaatttgtatccccttgatctccttttgttgtctaattgctctggctaggacttcaagtacaatgttgaataggtagggagagagtggacagccttgtctagtccctgattttagtgggattgcttcaagcttctcaccatttactttgatgctggctactggtttgctgtagattgcttttaccatgtttaggtatgggccttgaattcctgatctttccaagacttttatcatgaatgggtgttggattttgtcaaatgctttctcagcatctaaagagatgatcatgtggtttttgtctttgagtttgtttatatactggattacgttgatggatttccgtatattgaaccatccctgtatccctgggatgaaacctacttggtcaggatggatgattgttttgatgtgttcttggattcggttagcaagaactttattggggatttttgcatcaatattcataagggatattgctctgaagttctctatctttgtggggtctttttgtggtttaggtatcagagtaattgtggcttcatagaatgagttgggtagagtaccttctgtttctaatttgtggaatagtttgtgaagaactgggattagatcttctttgaaggtctgatagtactctgcactaaacccaactggtcctgagctttttttggttgggagactattaatgactgcttctatttctttgggggatatcgggctatttagatcattaacctgatcttgattcaactttggtacctggtatctgtctagaaacttctccatttcatccaggttctccagttttgttgagtatagccttttgtagaaggatctgatggtgttttggatttcttcgggatctgttgtcatgtctcccttttcatttctgattttgttaattagaatgctttccctgtgccctctagtgagtctggctaagggtttctctatcttgttgattttcccaaagaaccagctccttgattggttgattctctgaatagttcttcttgtttacacttggtttatttcgcccctgagtttgattatttcctgccttctactcctcttgggtgaatttgcttccttttgttctagagcttttaggtgtgttgtcaagctgctaatgtatgctctctctagtttctttttggaggcactcagagctatgagttttcctcttagaaatgctttcattgtgtcccataagtttgggtatgaagtggcttcattttcattgaactctaagaagtccttaatttctttctttattccttccttgaccaaggtatcattgagaagagtgttgttcagtttccacgtgaatgttggctttctattatttattttgttattgaagatcagccttagtgcatggtgatctgataggatacatgggacaatttcaatatttttgaatctgttgaggcctgttttgtgacctattatgtggtcaattttggagaaggtaccatgaggtgctgagaagaaagtatatccttttgttttaggataaaatgttctatagatatctgtcagatccatttgtttcatcacttctgttagtttcactgtgtccctgtttagtttctgtttccatgatctgtccattggtgaaagtggtttgttgaagtctcccactattattgtgtgaggtgcaatgtgtgctttgagctttactaaagtttctttaatgaatgtggctgcccttgtatttggagcatagatattcagaattgagagttcctcttggaggattttacctttgatgagaatgaagtgcccctccttgtcttttttgatgactttggcttggaagtcaatcttatcaaatattagggtggctactccagcttgtttcttcataccatttgcttggaaaattgttttccatcctttcattctgaggtagtgtctatctttttctctgagatgagtttcctgtaagcagcaaaatgttgggtcttgtttgtgtagccagtttgttagtctatgtctttttattggggagttgagaccattggtattaagagatattaaggaaaagtaattgttgcttcctgttatttttgttgttaaagttggcattctgttcttgtggctgtcttcttttaggtttgttgagggattaccttcttgttttttctagggcgttgttcctgttcttgtattggtttttttctgttattatcctttgaagagctggattcgtggagagataatgtgtgaatttggttttgtcgtggaatactttggtttctccatctatgtaattgatgggtaatttggctgggtatagtagcctgggctggaatttgtgttctcttagtgtctgtataacatctgtccaggctcttctggctttcatagtctcaggtgaaaaatctggtgtaattctgataggcttgcctttatatgttacttgacctttttcccttactgcttttagtattctatctttatttagtgcatttgatgttttgattattatgtgtcgggaggaatttcttttctggtccagtctatttggagttatgtaggcttcttgtatgttcatgggcatctctttctttagatttgggaagtattcttcaataattttgttgaagatgtttgctggtcctttgagttgaaaatcttcattctcatccactcctattatccgaaggtttggtcttctcattgtgtcctggatttcctggatattttgagttaggatctttttgcattttccattttctttgattgttgtgctgatgttctctatggaatcttctgcacctgagattgtctcttccatctcttgtattctgttgctgatgctcaaatctatggttccagatttctttcctagggtttctatcttcagtgtttcctcacttttagttttatttattgtgtctacttccctttttaggtctagtatggttttattcatttccatcacctgtttgtatgtttttttcctctttttctgtaaggacttctacctgtttgattgtgttttcctgtttttctttaaggacttgtaactcttaacagtgttctcctgtttttctttaagtgagttattaaagtccttcttgatgtcctctaccgtcatcatgagatatgcttttaaatctgggtctaggttttcgggtgtgttggggtgccctggactgggcaaagtgggagtgctgggttctgatgatggtgagtggtcttggttcctgttagtaagattcctacgtttacctttcgccatctggtaatctctggagttagtagttatagttgactctgtttagagattgttcttctggtgattctgttactgtctatcagcagacctgggagacagattctctcctctgagtatcagtcctcagagcactctctgctggcaagctctcttacagggaaggtgtgcagatatcttgtgtttggacctcctcctggccgaagaagaaggcccaaaacaggacctttctcagaagctgtgttgctttggcgggtcccagaagctcttagcttccgtggtgcagactctcacctgtgcagactaaattcctaagttcggtggagtccgggaaccaaggtggcgcccgctgttcctgaggctgaggccgcctcccgagccaggtggacacaaatggttctgcctctgcggctctgtgcctccgcctgtcccagaagctgtccagttctgtggagcaccctctcacctgttcagactaatttcctaagttctgtcttccacatttcttaaaaagaaacaaacaaaaaaaaaaaaaaaaaaacccagcaaggtcaggcaggtctgtcacagcaatagcccacttcctggtaccagcttctgtatagatgcttttcaattgctatcaactaagggttttacattcaaagtcttcaacagaagcatggaaattgccatcgaccacatgttgcagtgtcaaaacaatcctttgatatacacttccttcagggatatttttactaggggtaaattgatcatattggagcccattcccataatcaccagattaggtggcatagaaacacatctggatggaggactctgctcctgggcattcattggtgacctccagcttgctccccagcagaatgcccaccttactggcaaattcctgtggggtcactttgggaaactttatggtaaactctggtcccaactttcttgccttgggtcaactgagaagcacataagtcagtcatcaccacttgatcagctcccattgctttgccaacaaacaaaatagacatcccaaattgttcaggtctacacacaggaccttgtttgccaggataactaaacctcaatagcaggcatagatccccacagagaggttcaataagggactcttcttcacaggtgacactgttaggaagcttgttgcagaagtcaacacagtgcttgtaaaatctgaggagtgtgccacaaaagaagatagatggtgtcaggttgtattccctaatctggcagtactcatctacttctcatggaatgccaggctggatggtaacccgatctcctgattttagatgtttcactgaagctctttctttgtgactattctagcagcctcatgcccaagctccattggctttttcataacaaaatacccaatatagccattctcccagaggtaagcatctgagctcctgatccccactggatgcatctttagaaacccgttgtttgagcccaggtcaggcatttagtagttctccaggtgaatgtctccaagactgtgtaccacctgggagaggttcttgcctttagatggcactgtcatgaggctctcttgcttcaagtgtcggctagacttggcagggagctggtacttctacatacatcggatttctgaaaatattgatagcaagtctatggagcttatctgacttagacaacttgcatttatttaattacttatttaagaatatatttagcaaataaatatcacatagtaacttaatggtagtagcaagaataaggatatatatatatatatgtatatatatatatatatatatgtatatatatatatatatatatatatatatatatatatatattacatacacacacacacatatacacacatgcgcaggagtgcgcgcacgcacacacacacacacacacacacacacacacacacacacatatcagtgatctttaaccttaatactgtttagctgatgtggaccagaatgagaagaacccagaaagctgacaacagcggtaggagctgtacaaaaccttagctgaaccgagtaccagggaggaacagtgtcacccaggaaggttcaagtatgtagcatgggctgaatgtgtgatcacacaggcaaacatcttactctttgcaatgtagtgtctcatacaatgtgacagctagaagcaaatggctgtgggagtatgagaaaggggtttgggacagatgttgtcagggaaagcagtgactcagcagaagagtgtcccaggcagaattcagaagggcaaggtgactggtgaagagcagcttttccataggagcagaatgaagaggtacagcaaggccaggcctgccagcccaagtttccttctccaagctggaagcccaggaccaggctgtcagaatctgtgttgggtgggtaagggaagcacctgaagtagctttctgtctcttcacaaatcaggctgtagcagctggaagatgtgcagagtgcaagagctaagagggtcaagtaggcacaggaaagtagtctctcagcagaacagtgttccaggcagaatggagaactgcagtggggctggtggggagctgcttttctgctgcagcatcagataggggtggcaaaccagtacagggagcagagcaagagcagagcaaacagctgataataacggaaggaggggaaaatcatatggagcaacagaaggagaattattttgagacttccaattaaaggccatgtagagatattgcttgctgggtactatgactcagacctagaaataccccagtatgtgagaacaagcctgcaaagactaatactttagatgagaatagagttattaattacccctacaagtcttgaggataaaattagtaagtagagattgacagtcgggtcagatcaccaggtggtcaagctattaacttggggactaggctctaggccaatgcactgaatcatggtgcctaggattttgcagcatcaggaaagggactgcctcagacaagagagaaaaatctaacctaagagaaaatgtcctagaatgaagggttagtgagaagaacagtcttaagtattgcatgtctctgtcttcaaggacagcaaagtggtgaccccaagttctataaacctcccttgagaccagaagatatttacactgaccagcttagttgttctccaaagtttatgtggacaggtctaacaagagatggctctccatgtagcattggggaatgtgagccttcaagtgtctaaatccagtcctttggcaccagtgttgtgttttataaaaagttaagaagctgtgcagtggtggcacacacatttaatcccagcacttgggaggcagaggcaggcagatttctgagttcaaggccagcctggtctacaaagtgagttctaggacagccagagaaaccctgtcttgaaaaataaaacaaaacaagaaaaaaaaaaagggaaggaatatgtttggtgtagacatggtaaggtgtttggtaagtggtgcctctgcaggccattgctgaggtattcctttcctctgggttaccagatagtatatcacaagataggaagatagtatagtatagtatagtatagtatagtatagtatcgtacagagatcattcagggaattgggtggggagttcagggggatgtaaatacagagaaaagcagagagggggagggagagagtataatagtataagagtagaggcctgccataagcacggggagagagagggggaagggaatggggaaagagaaggtaatgagcaggtacaagtggaaaagtgcaagaccaagagagcagaagactgaggagggggaaagcagcccctcttctagtgagtcagccatatctgcctcttgccaagtaactgaggggcaaagcctagataaaatgccaacaactcccatttaatgtacttcctttgtagttctactttggggattaactctagttatattattatgatagcataaaggagcacaaataaaatattcctgtacacctgtctcacttttctaagtgagatttggtattgcagatgaggtcttttgtattagtctgtagatgctcctgtaaaggagaagtaataatatggcagattaatacatcagcttgcttattttatagagaaataaaacaaaggaggttaaagtgtggataattatgaataataaaaatatcatgtgttttctcacaaaatatgttatagttcctagaaaatggaatcagaacagaatgtgaatatgattttagactattaccgacacaaatgtttcagaagatcagaatgcctcacgttctattttgattgatcattgtgttatttctgtgatcctacttctgtgctcataaagatgaactggtgaaaacacacacacacacacacacacacagttagagagtccctaagctttatgggttaagcttgcactggtcttttgtatgttaaggacagaatctgattttatttttcaaggtattaaaatagaatttacatcaatatgtacatttgaaatcatctttccccttaggaagaagtgaggtcagcaggtagtgagagaaatagaaaggatacatgaaataatctttacaattcaaatgtggtaatgcaataataattatgtccctgtcatttgatggatctacttaaatacttagacatatagacatctttatgccatgcttaatatcaatcgctctgagacacaaggaggtagacctgctgcacagtgtcatatgtaaatgcaaatcaaaagtcatgaattgacctataccctaagttacatgttgcctcaaatcttaaaaaaaaaattctatcatactgcactagaacctatattttaaagttttctccattgttcccaatgaaaactactaatagctgcctttttcaccttcagggagttattttgaaagtacataaaacacctttttctacaaataccctgtattttggaatgaccaacacaaatgataacaacaaagagtacaatatatttcaaagattaagcctgctaaaaacaaaaaagatacaaaaattgtatagaagaccataaagtttgaaattttttgatccatttttgaaaatattttattaaaaatcatttaacatttcataatttagtttgtctgaatggtttattaggagttaaaaagtaattcaatatttcttttctcccagtttgattgaatttcctttgaaatagttaagtatagaaagtgaagaaaaccacttaggagatataagatttataaagtatttgaaaagaaaaaaatcacatgatcataaagaagcctaatactgtcatatttaccatcagtgggactgtcacaagcagaggagcaggcagcacccttcacctctgcttgttggtatttttaaggaaaacaacaataccaacaacaacaacaaaaaaaaaaaaccaaaaataatatgacacatgatgtataaagaaagggatttagggttatatacaccaaaccagaattcattactgaagctgagtgatagcattcaaatgatcaggcacttaaattttacttctgagttgaaatttacagcaattgatgactggttcatggaacataggggctctattacataaagcatatttaggaatacattaataaggtgtcgtaactctagttcagtagcttactacattccccacatttgatttcaatattctgaatccttaactcagagtatggtgaaagtactcttagtatttatactgtattttattttattttattttatcaccgaggtagcagggatacaaaggaagtaaacatcaacatctacaaatatatatttggattcataaaacagtaggactgagaaaaatatcctttacactgaaaaaatgtggtaaccatgaagttagccacccaatcagatcatagtccctatactgagttggctgttcatttcaaattttgtaactatggttcttccaaaatatttgtgatacaaaaggactctaaaagcttatatatgcactgatttgccaatagtcaccacaggtagtcattttcccttttttgcaatgagaagggtagtagttcttctgaaagtggggggcggagtttcatttggactactgatatagtatttttatcaagggtcatgcactttcttctgtaactccttctcagttaaacttagggtgtcattatcaggacacaggaggtaggaactctggtccaaggccacgaaaagattaagacaatgtgtccagggtcataggaagcatattattcattgacacattctaaatagatacctcgcaaccacattagctgggataggttacatcaaatttcagccactccacagatttctggttttgtagaactgtctagggtgaatgtagtatagaatattttagagcagttttagtccatagctgatttctccatggtgcctgacagttgagcagaaatcttttgggacacatatgaactaggacagaaggcatagatgcagtacttagtggaaaatctgtaacttctgggtatatttgaaattttcactccttggtcttagtatttcagaaagtagtagcagtactgagactagtagatgatgtgcactcatacacacacacacacacacacagaaagagagagagagagagagagagagagagagagagagagagagagagagagagagagagagagacgcttaggaataggcagtaattgtataagcttagacttatgattgacagttatacttatctgcagtccacttccttatgacctgtaacaggtcgaacaatctcacaattcacggaattttttccttatgtttttatatttattacataatatttacagttatgcattctattaatttattatatagcctaatcaccattcacctcccggtctgtcctccaccccctccccatcttcctttcctcccctgtctcaaataggatgtcaccatcccctcaccccaccccatcagaccaaacctcagcataaaagtattttttttataatttagcattactacaattcataacatgtatttaaattctcattgtaaaagtctagttgggtggaggaaggggggttggagacagggaatggagaggagttataggatattgaggagtcggagggtggactataggggaataaaatctggagtgtgtaaaaaatagataaataaaagaaaaaaggtaagctaacaattgtctataagttgctggaaaatgctaatgactgtgaataatagcaaaggcagatttttgaaccattctttcttctatcaaaaaagctggaatatataatgaacagagttattttagcagagtgagaaggattttaacgttttaacgctataagtaaaggacaagtaaggaaaattttacaacttgagcttctgactatactcctactcactgctttatcactagcagattaatagtttatcccaactccattgattaaagttcacacatgaaattcctttttcagatcctatgatttggataaatctttttttttcttttttttcttagatattttctttatatacatttcaaatcccaaatgctatcctgaaagttccctaaaccctcccccagccctgctaccctaaccatccactcctgaatcttggcccttgcattcccctggactgaggcatataaagtttgcaagacctaggtcttcccagtgatggatgactaggccatcttctgctaaatatgcagctagagacatgagctctgggggtactggttagttcatattgctgttccacctatagggttgcagaacccttcagctccttgggtgctttctctagcttctccattgggggccctgcgttccattttatagatgactgtgaatcttaatcaccctttttccccagtctgatcatttttcatgacatacaaatggatgattacagagagtagtcattgaaaagcaatttctttaaataagggaatagtgaaaggtaaaattttagataactatagcaacatgctatctggagtggatttttacactgtaatttttatctgtttaaagtgaaaactgtgacctaaataaaccattttgtttgtcttcctttctcttcaggggacctagaagctctagaaaaactaaaagaaacaaacaacaaacaaacaaacaaaaaagaaaaatcaggacctgttttacatatgaaatttactgaataggcagcagttgctgaaatgataaggctaaaattagccataaatatcatcaaatttctgacagaataatttgaatgggaagtctatacaaaatattccttgtatcaagtgaaataagatagtttaccactatctgaacattgttttcttaaattgcaacagaaggaagcatcaggtttaagtttctagacccacaagatctgagagattgtcctgatgtaaacaaacaaacaaacaaacaaacaaacaaacaacctgagagactggatcaccattgtgaggcaaacaggatctagaggaaaaggacaattttgtctaacagttaccagtaccacaatattggtggcatcctcttctttggaaatgttcatagaactgctgcaagaaactggaattgttaactattaaagaatcttaattttggattttttttttattttggctttcttttcttcattagacactttactgcaatacttagcagatctctgttacttccaaagagttttgagggccaccaattaagtttacctcattttaaacaaactttacttgttttagttttttgcttcagattaattcttgaaaacatctacagaagatgaaataaagcttttcccaattagtaaattacttatgtaactgatataactgaaagcatagttctaacaacactaacaaatttagccttttataaggtacctggccattaattgtcttgacttaattctatttacaagtttataccttggactttataaaattagaattttacagctttcacattactaaattttaaacttaaattatgatttggagatcaaacatcaaacataaaatattaaaccataagtagggtccacacagggtggataatatttattttattgattttttatagtacacatttataggatatcacagattttttgtataaatcagtttcttcaaatagctgtaacttaaataaagttagcaaaggcaacatattacacatgcatcttgaagtcagtttgcactagcctgactagaacttaggagtttataacaatttatcaaacatgtccatttatccaacttatgatattctttcttttgcaagttccttttccaccaagtcgtttccttttatctgcacctaagaatgttttattgtccttttataagtgatattcaaggaccctctcttattcttaccctctccttcagctccttttgaatatggaatgggtacctatactttctggctaacatccacttctcagtgagtatacactatgcatattcttttgcatccatgtgacctctgttagtatgaaaatttctagttccatccatctgcttgaaaaattcatgatgtctgtttttaagtagcttagagtattctattatgtaaattaccttattttgtgtatctattcttcaggtgaggcgactctggtttgtttctagtttgtagaaattatgaatgaaagaactattagtatattggagcaagtattattgtgctacattgtagcatcttttgagtatatgctcaggacgattatagatagatcgtcaggtagaactatatccaattttttaagaaacctacagattgttatccacaatggttgtaggtatgagtaatcaaccaaggacatcaagcactctccttcaaggaactatgaaagaaatttaaagaaggggttagataaacatacaaccctgtagcattacagacatgacaccatcagtacttagcctatttaaactaaataataatttctactggacaatacacaggctgtattcaggaaccatggtaaaaaaatacttgaaagctgtagaattgtgcctcttctatataaatactatccagatattcaccaattttttgatggtgttacacaaatagcaaagtttaatatttattgactgaatagatggacatgttgtttttaggtaagtcatgcctctgtaaatgtaatactgcagttttacatattcttgatgatagtcacttctggcatgatttgaaaatacatcactccatttgctgagatgtatttctgcgggctatgatttctccgtttctttcttaatggctgtttttttttctttgtgttactatatatattagtgattagaaatgggataagatggggaaaattgtggctcaaagaatattatgaatataccagttgcaatgtcttgtctctctaggttcatttcagcagagtagatgcaggaaactatcacctacataatagttttcatccaccaatctgctagccactagaaaatatttctctaacaagctgtctccttatacttatggataactttatctgttgaaatatatatcactttttctttgtgttcttctaagcatcagggcttgatcaaatttgaatgacaagcaaattaaaggatagtctcatgtatataaagtgagtttgagtggactctgctagctcagatggaaagtactgcgtctttttggaacttttgtaaatttctttaacacaactagatcaaggaaccagattattgtataaagttatttattgtatataacaagaaggaaggattatggtatatgaaagggtatgcatgctcatatactctgtattgcagcatatcccaactgcaggcatctaatgaggtgaaacctgtggccaattgtttctatgtacactgttaacatccccatggaagttgcaataccacctagacttacatgggaaaaaaatttataaatatagtggatcagcttattgggttattttacattgccatggccagaaacaataagaaacatacttgtataatttaataatctcacacaagatttctatatatttcttgttgttttgtggtaagataaacatgagtgttcatacatacatatattaacatggcttttaagagtataagaccttaacagctgtcatcctatactccctttattaattctataattttttaacttctgatttaaatgcagtatattattttgggtacaccaactgtgagttaaaccataaacaaactcttaattctacctctttgagaggctatcagtcttcagtgagccaccagcccaaaacagaactgaattactgatgggaatattattcaggtcataaaactcaacaagtatacaacactgcctgtttaaaaaaaagaagatgcactctttcaaagtgcatagttctgggaaagtctctaaatatattaactgtgttttctttggtttggtttgtactgttttgtttttttgtttgtttgtttgtttgtttgtttttctgcatttttagttctgggtgttcctgataaatataaatatatcaacccaagctataggtgatgtgttgaaaatctcatcctgggaaaatatacagaacaaaggatgcaattactggataattaataaatatgtttccattgccttaatcttgtgtttcagaagacttcttttgtagacacatcactacacctccgaatcctataaaactatatttcactagccttatgcttgacagatttttatatttatatgatttaaccagggcttgtacatagatcttgtgtgcacaatggccaatatatgaactgagctctccatatagcctcattttttcttacattttattaatatatgaatgaaatcataaatttctgttcttatcagttgtttgactagttttgttatcaaagccatcatatacaattgtctggaaaaaataatttaacatgcatgattattataaataatttgcattaattattaaaatattttatttactaacacgggaattaatcctgaatgttcatgattagaacctaaaaaacaaccacatgaacttggaaggagacactctcctggcaattcttgaattcagatttcaccatcagccataatctacatctacgttttctgactggaagacagtgagtagttgccatgtggctcctcaaagacattattcatttattttgtacaataaaggcataacacagatagaatgatgcattagttggtatgaagttgagaactaatcatagaaaatgatggcattagagaaatataaaaataagtaaataactattttacaagtagtttgggaagtttccactgtaatttgcacaaccatatacactcttcacatgtacaataatactccccacctctggagatttttgaactctatagacctttctagatataagctaaggggtatgtttaaattacaaaagtagggtggttaataggatagcagcagaggccagatacatcaattgggacattattggactcagttcagacgttgaaatagaggataattgaagaattgaagaggatataagaggaatgattctgtgaaaattagcgaagtttttgcacacaatgttagtgcctgacatgcaatatgatgtgtccaacattaatgtatgtgtcaaagaccaactatgacactgcagagcaaactacagaagtctgcaagtcacaatggcatgagttagttgtaagagcagctgcaggaagctggtccagataatgacaggaactgctgcctatgtcaggcagtgataagacaggatatgggggtccaaacatacaaacacacaaacaaacaaacagaatggttgaaacaactgccaagtttcagcaatttgttttttctctcaacagctatttagatcaattaagacaaaagtgtttgtactacacatgtcctagagacactcactagcaaaacataatcttcaaacacagattaaaatctatatttgttaccttaaaccagtaattatttagtcattgattaacaaagtttgaatagtccaagtctatagtagcaagttaaagcctgtgcttggttgacaatcatctgcacttactcaagagcagtttgcatatctccatcttatttttgaagttcagatcagctaaggtggctaatcattcattctctgttcttaaaataaaaatatttgttctttattgtaagcttagggtttcctggagcccatagaaaacctgctaccttattcctagatcacaagattagtgaactcaggcccaacttagactgcatgcttttttgaccaataacttgccccaagtctatccttcttgcctctcaaattacgtgcttgtaattcatgttgaatgctcactgtatgcgtttttgtaactcacacagtttttgccattctatcaggaatggtcacactgttttttaattctaacataaaaatttttctttttccaattttattatgtatttacttcatttacatttcaaatgttgtccctgatgcccccaataccccctccctgctaccctacagtccaacttcttggccctggtgtttctcatgtactggggcatataaattttgcaaaaccaatagctgactgtgagcatccacttctgtgtttcccaggcattggtatagcctcacaagagacagctatatcaaggtgctttcaccaaaatcttgctgccatatgcaatagtgtctgtgtttcgaggctggttatgagatggatccccgggtggggcagcctctggacggtccatcctttagtctcagctccaaactttgtccatgtttctcagcctgtttatcctttgtatagagaaaggccactgacttttttgagttaattttatatccagctacttcactgaagctgttttatcaggtttaggagttatctggtggaatttttagggtcactcatatatactatcatattactgcaaaaggtgatattttgacttcttcctttccaatttgtatccccttgatcttcttttgttgtctaattgctctgactaagattacaaaaactatgttgaataggtagggagaaagtgggcagccttgtctagtccctgattttagtggggttgcaaggattttattgagtatttttgcattgatattcataatggaaattggtctgacattctctatctttgttgggtctttctgtggtttaggtatcagagtaattgtgacttcggagaatgaatggggtagagttccttctgtttctattttgtggaatagtttgagaagaactggaatcagatcttctttgaaggtctgatagaactctgcgctaaacccatcttgccctaggctctttttagttgtgagtatatgaatgactgcttctatttcttttggggatataggacagttttggtcattaatctgatcttgatttaactttggtacctgttatctgtctataaatttctccatttatacccaggttttccagctttgttgagtataaccttttgtagaaggatctgatggtgttttgggtttcctcaggatctgttgtcatgtctcccgtttcctttctgattttgttaattaggatgctgtccctgtgccctgtagtgagtctggctaagaatttatatatcttgttttctcaaagaaccagctcctggtttggttgattctttgagaaaattcaaataaacaaaggtaaaatgatattaaaggaatggagtaacaataagggggcctggtggctactctagcagttcagacaggactgtgtgcaccagggacattgggacacaggtgaagctttagtgatttggggatttctgatttctgatataaactgtgaattaggtgaagtttggggataggttagtgatcttgataagcatatgaaattatttcttaagttattaaagaaatttttagttctgagctgcctgagctacatgtatttcatgcagagagcatcagtgtcgtggcacttctgagtagttacttgttggagagtttttttttaaattatctttaatctgttttttgtttgtttgtttaggtttttttgttttgttttgttttgttttttacagttcagtcattatccccttcttggttcatcctctgacagttccggatcccattcctactcctgtttctccaagaagatacccctccatatcctgccaggacttgccactccctggagcctcaatgtttgatgacttttcactcactgaggccagaccagacagttccctgacccgtccagcaggtccagttattcgaggatctcgagaggacctcctcctaataaccaaatggggggtagagagagacgagggccttgtgcgaataacgacacagaaaccgttctggaatgcatcaaagcccccaaatgtttttgccaggcccgaggtttaaatgtacaagcaaaaggggaagtgcctttcagcaggaaggatggggcagtagaattgcacaaggaaacagggaagtacagatacttatcagcgggagggatggggcaatataagcaaaaggagaagtatttatcagtgggagggggggcaatagaattgcacattcttaggcagttacacggggaagcaggaacttggtggtatcagggtatcttgaagtcaggacatccggcgctgacttagggctggaacaatctgtggttgttctcagagcggtgtgtcggtggcctgcttttgaccctcttttcttcttggggggagaggcccaattcagagatcaggacaatagcgttgcctaaatagctcccaacagttccctgtctgaaaaggagacaccttagataaaatgcccaacactggggagagggagcttgtagagtccacttccagtagaaagataatgcctcagtggagggatgaggttgtcattccacagtcacaaactctgtcccagagatgtagctgtctcttgtgagactatgccggggcctagcaaacacagaagtggatgctcacagtcagctattggatggatcacagggctcccaatggaggagctagagaaagtacccaaggagctaaagggatctgcaaccctataggtggaacaacattatgaactaaccagtaccctggagctcttgactctagctgcatatgtatcaaaagatggcctagtcggccatcactggaaagagaggcccagtggaaacgaaaactgtatatgccccagtacaggggaacgctagggccaaaaaaaaaaaaaaaaaaaaaaaatgggaatgagtgggtagggaagtgagggggatggtatgggggacttttgggatagcattggaaatgtaattgaggaaaatatgtaataaaagaaagataaaaagagaataaattcagaaaaaaaataaaagaactgcaggggcaaaaatggataaaagactgagtgaaagtgaccggcacaatttgagatacatctcaaggggctccaagacctgacactattactaatgctgttgtctgcttacagacaggagcagtcctctgagaggcacatcaagcagatgaccaagactgaagcagaaactttcactcatccaatggacaaaagctggggaaccctgtggttgaattggtgcaaggctggaagaatttgtggaggaaggtgatttcactgaaaaacctgcaatctcaacaaacctggacccctgcaatctctcagattctgaaccactatccaagcagcatgcactagcaggtatgaggcccctgacacataaacagcagggaccatgcccttatatctggtgttccatatcatagagaaaaaaattcatatgctcatatctaaaggtaagaatattacttaatgagcaatatatccagcctacatattttgatattataccaaaaagtaccaagtgtatataattcaacatccatacttataaacacattgtagaaccctacaatttcttacaactccaggtataaagctgtcctaagagttcattctcaaatttaaatattatttttctgactactttatttgaattttgaaaaatgggaaaaaaattttgttgttcttctgtaagttctacacatatagtggaacaagataaacacagagagcacattgatgtgctcacattcagtgtcatgcacataaagcaagattctgccaaagatccacatagacatacagtaattctactttccagagtgtgacaaatgtctgttatgaagaaatgatttgtatgaacagttttctttatacgcagatttatctgaatcattacattgtgtttttcatatgtattattcaagaattataatattttgaaagtaggtatttcatattatagatattatacagcttgctacctacaaataaagcatgttaataatagtaattatatcacttaccctttccattatcttctattactttctaatccacataactgtaattctttaaacagccacactctcaagtctcttatttccttcccttcatctttgtatttttcttcacttatatagattaatatagtaaatatagtaataagtaagtatactaatatagtaatatataatatagtatatatacatataatactatgtagtactataaagcaaccaatactaaatatagtaatacagtaaaataatacctccatttcactctgttttacctaaattatccagcgaataagaggttactgtagagaacattgtctgcacattattactgcaatatttcttgaaacaaataagtaatactgaacagccatcttggccatgtgtgtctttcctactataacacagtgggtacatactcttcatgaacttgccaattctctaacctgttaatgttacttcaggatattgaaattttctctaaacgtccaatagttttcagggcatttctttttcttttcttttttttttattattaggtattttcctcgtttacattttcaatgctatcccaaaagtcccccatacccacccccccaatcccctacccacccaatcccccttcttggccctggggttcccctgtactggggcatataaagtttgcaagtccaatgggcctctctttgcagtgatggccgactaggccatcttttgatacatatgcagctaaagacaagagctcccaggtactggttagttcatattgttgttccacctgtagggttgcagttctcagggcatttcttaatttacaaggcaggctgcaatttttcaagcaggaataccagaccaaactctgtaaaagaaaacagcctgcagggtaaattccctcataatcacttaggactggcatatcctctagatagaggactcagcccagccttagttgcattgttcactacctactgtatagaatatgccactagtgatataacaagaaagctcaataaacaatgccacatggagaatagattaacattgtgttttttcccatgcaaaattcctgccatagatgatatacatgaaatttactgggagtgtgggattatcataaaatctctgcatcacagtgaaaaggtcagcataggaactttggaaaggtcatgaaacactcacccctctgaaagagagaggctaattagcatttctgagaccacagggtgggaacagacctgagggtggggacacattccacagggctgaccattgctcacctcagacaagggaagtccttgtcacctcattccctaaagaccaaccagtttaaagggtgcactattctgcacagtgtgactagttgctgatgctctgttctgcccctggaaaccatattaaaaaaaaaaaaaaaaaaaaaaaaaaacttgctgaacgggtactgcgggttgatgcctctccttcaggtctgggatgagcccagtgcactggaacaataaattcctcttgctttttgcatcaatcttggctccaagtggtacacttggatgttcccagtgagctaaggctccctgaagtcttacaaaagtcccctcatattgggttctttcccttacctgaaacatcccctgatatgagatagtgtttgctcatacttcagtaggattcagtaatgttcaaggccaaggaagcttggaaaaatattggggctccatgaaccctgttttatattacataaaccttgcataattactggttagaggaaaccactttcaggggaactgcctgcaatttgagcagatacctctaactctcctttatggcagatttcataagttgtaactcattttacaaggggttgtttgatgaacagttgccatctattaaagtgtgccttcatgattaatagcaacaattcattggtgcaaaaaaaacagacattgagtaattcagattctttcagaatacgcctctctctttctcagatagccacttaatcctgtaaagtacaaagtaaatgggaatgtaaaaaaatatatttcacccatgttattttcagtataaatttcttctatcacactgcctattgacctgttgtcttaggattcttgtcatctcaataaaacatcatgaccaaaaccaacttggaaagaaaatcatgtatttcattatccagttcatgtttaatcctactgataagtgaaggtaggaacttgaaagcagaaactgatgcagagaacagtggtggatgtttcctacttactcattcctcatagcctgaccctcgtgatttctggtaccatccagtgtcacttgttatggagtggtgatgatcacagtaagtaggacacttccacattaaccataatcaaaatactctacagatttgtttacaggccaatgttatggatacactaaggctcttttccagacataatatatatatatatatatatacatatatatatatatatacatatatatatatatatatatatatatattattagatattttcctcatttacatttccaatgctatccccagagtcccccacaccccccactcccctacccacccattcccattttattggtcctggcgttcccatatactggggcatataaagtttgcatgtccaatgggcctctcattgcagtgatggctgactaggccatcttttgatacatatgcagctagagtcaagagctccggggtactggttagttcatgatgttgttccacctatagggttgcagatccctttagctccttgggtactttctctagctcctccattgggggccctgtgatacatccaatagctgactgtgagcatcctcttctgtgttttctaggccccagcatagtctcacaagtgtgagactatgcagggtgctttcagcaaaatcttactagtgtatacagtggtgtcagcgtttggaggctgattatgggacagatccctggatatggcagtctctagatggatcatccttttctctcagctccaaactttgtctctgtaactccttccatgggtgttttcttcccaattctaagaatgggcaaaatttccacactttggtcttcgttcttcttgagtttcatgtgtttcacaaattgtatcttatatcttgggtattctaagtttctgggctaatatccacttatcagtgagtacatatcatttgagttcttttgtgattgggttacctcactcaggatgatgccctccaggtccaaccatttgcctaggaatttcataaattgattctttttatagctgaatagtactccattgtgtaaatgtaccacattttttgtatctattcctcgtttgaggggcatctgggttctttccagctgctggctattataaataaggctgctatgaacatagtggagcatgtgtcttttttactagttggaacaccttctggatatatgcccaggagaggtattgtgggatcctccggtagtactatgtccaattttctgaggaaccgccagactgattttcagagtgtttgtacaagcttgcaatcccaccaacaatggagtagtgttcctctttctccacatccacgccagcatctgctgtcacctgaattttttatcttagccattctgactggtgtgagatggaatctcagggttgttttgatttgcatttccctgataactaaggatgctgaacatattttcagttgcttctcagccatttggaattcctcaggtgagaattctttgtttagctctgagccccattttttaatggggttatttgattttctggagtccaccttcttgagttctttatatatattgggtattacttccctatctgatttaggataggtaaagatcctttcccaatctgtttgtggcctttttttcttattgatggtgtcttttgctttatagaagccttgcagttttatgagggcccatttgtcaattctcgatcttacagcacaagccattgctattctattcaagaatttttctcctgtgcccatatttttgaggcttttccccactttctcctctataagtttcagtgtctctggttttatgtggagttccttgatacacttatatttgactttaatacaaggagataggaatggatcaattcgcattcttctacatgataaccaccagttgtgccagcaccattttgttggaaatgctgtcttttttccacaggatggttttagatctcttttcaaagatcaaatgaccataggtgtgtgggttcatgtctgggtcttcaattctattccattggtctacttgtctgtcactataccagcaccatgcagtttttatcacaattgctctgtagtacagctttaggtcaggcatggtgattcgaccagaggttcttttatccttgagaagagttcttgctatcctaggttttttgttattccagatgaatttgcagattgctctttcttttttttttcccccattttttattaggtatttagctcatttacatttccaatgctataccaaaagtcccccatacccacacacacaccccactttcctacccacccactcccccgttttagccctggcattcccctgtactggggcatataaagtttgcaagtccaatgggcctctctttgcagtgatggacgactaggccatcttttgatacatatgcagctagagacaagagctccagggtactgcttagttcatagtgttgttccacctatagggttccagttccctttagttccttgggtgctttctctagttcctccattgggggccctgtggtccattcaatagctgactgtgagcatccacttctgtgtttgctaggccctggcatagtctcacaagagacagctatatctgggtcctttcagcaaaatcttgctagtgtatgcaatgggattgctctttctaattccttgaagaattgagttggaattttgatggggattatattgaatctgtagattgcttttgccaagatagccatttttacaaagttgattctgccaatccatgagcatgggagatctttccatcttctgagatcttctttaatttctttcttcagagacttaaagttcttatcatacagatttttcacttccttattattaagctgaaaaaaagcaaaagcacacctctcatttctattcttagtaaatttcatacttgaaggaataatatatatatatatatatatatatatcccagtcaaagtatctttatttaatatgtaatacctagtgtctaagatcttcatcacagtgcaattttgaaataaagttgatgcagagaaaatattgtgagttgtatccactttagtattttaagatttatcctgaggcagttgatgatctacatctttatttaagacatttctgttgatacttaagttatggcaaatgttgtatttcttatacattaacctaacatatgttgtggtttttgtttttttaagatttttcttactgtgttatcttttatgacatagctcatctttaccttacatatttttttcatctttgggagtttagtatttctccagaaatacctgatagtatagaaatctgtgaatctaagaaattggcaccaataaacacattggacctatttgtaatgcctctctgggtctgcatggcaaatgctgtttgctgtgcattacagtctctctgggaaaaaaaaaaaaccaacatagaattttgttgtatttatatgaaaattgactaactaaataagcacactttttgtatgtcaaaagtatatgtgaaatataatgctttgagagggtaactttggtgagtccaggaaggtgcacccctgagaaattaagccatgcagcagatctggtatgaaagggatttattggggaggattgaggagtaagaatatgaacaagggatagatgcagagaagtgcacatgtagataagcagataaaaaggagcagttcagggagggcagataaaaaggggagtagagaaagataatatgccaggaacagagagagaaacaggagaacagagagagatctaggatggtggggagcccttttgctacacatacctagcactcctggcacacctggtaggtgctcaggtagctaatgatgtgggcatctgctatgtccctgagaacaaggcaaggaaatcatctctatgctaactatatgagcataccaaccccatgcttccattagttgaatctttacatatgaatttcaataaatgtgattttttaaaattttaagtgaatttaatttagtactgttttcaaatgaataattcatgattttaccaagtgttttaacttcaggtttttttgtttgtttgtttgttttgttttgttttgtttttgtttttggtcaattgatttggacattaaaggttatttacaatgttatttgctacaccttttaaaacacatttctgcaactccacttaaaatatctctgcctaaatatgaggagaaaggaggtttcagtaatcataaggaaacattttgcttaatatgctagtactgtttatggattctttcatttatagttttctattgtgaaacatttagaaaaatatgttcaaagctgaaatgcaaattacttgcagtctgtttctgtactcatacacttatgacatttacatttctgtttttcctaaatgttacaagcattatctgcataatttgatgcttttcataacactagttccgtttatatattttcttgtgtatgtgttcttactttaaaaatttagtctctaatataattgtatattttaaaaagttgttttaaataacagccacattacttacatccatcttggctgatgtcacattagaataaaaaagatcctatgattgtcatcccactttactaaggttaaagaatccatgccatatctttcaccactgctattaagatgatcatatggtataagccaacttaggcaacactgtaaatctcagcatctgcagaagtggcaagaggtcaccagaagaccaccagaacttttttggtgcatttttctttactaagacactacacattgtgatcaatgaagtatggaggagaaccaatgccaaagtgttgtcattgagaaccaacatctgagaagctcgacaaagatgagcaaagagtggcaaggtgaaccgatgatacaacataattcactgtctattattttatacttataagctttccaaatctcacatgtactctcaagtgtctagcaaaacatcaagtgctctttattcaggaagcatccagaaaagctactaaatactttttataattatgtcttctttttattatatattttctttatttacatttcaagtgttatcccctttcctagtttcccctctaaaaacccccatcccctgccctaccccttctcctggtaaccaagctacacattactatttcctggccctggcattcccctatactggggcagataaccttcacaggaccaagggcctctctttctgttgataacctattaggctatcctctgctatatatgaggctagagccatgagtcccaccacgtgttcctttgagtggtggtttagtcccagggaactctggaggtactggttagttcataatgttgttcctcctaggggggctgcaaacaccttcagctctttgggtactttctctagctccttcattgaggactctgtgctccatccaatggttgtctttgagcatccacttctgtatttgtcaggcactggcagagcctttcaggagacagccatatctggctcctgtcagcaagcacttgttggcatccacaatagtgcctgggttaggtggttgtttatgggatagatcccaaggtggggcagtctctggatattcattccttcagtctctgctttaaactttgtctctataactccttccatgggtatttccccccttctaagaaggatcgaaatatccacagtttggtattttttccttcttgagtttcatttgtttttcaaattttatcttctttttaatataatataaaaatgataagattagacaggttttcttagcttaaaggaatctgtctcaaagatgtatgtttaatgatttgtctatggctatcaccaagcttctacacattttttaagatgttattttattttaatgtatatattaaactccatattcaattccctgacccatccacactctcaccgttccatatcccacaccttcttcccttccctcctcaccctgtcgccatatggatgaccccaccctgaccccacctgacctctaaacaccgtggggcctccagtctcttgagggttaggggcatcatttctgaatgaacatagaccaggatgtcctctactgtattgtgttgggggcctcatatcagctggtgtatggtgctgtttggtgggccagtgtttgagagatcggggacgtccagattaattgagactgctggtcctctacaggatcatccttctcctcagcttctttcagctttccccaattcaacaataggggtcagctgcttctgttcattggttgggagcaaatatctgcatctgactctttcagctgcttgttggatatttcgtagggtagtcatgttagttccgtttttgttagatctccatagtctcagtaaaagtgtcaggccttaggaccactgctcgacttggatcccactttggtcctgttgatggacattcttttccttagggtgctctccatttccatcactgtaattctttcagacagaaacaattatgggtcagaggtgtgactgtgggatggcaacactatcccttacttcatgtcctcctatctttctgctggagatgggctgtaaatttccctctccctactgtagggcatttcatctaaagtccttccctttgagtcctgggagtctctcacctcccaggtttctagtccatttggagggatccccccaacctcctatttcctgaggttgcctgtttactttctttctgcttggccctcagggcttcagtccttttccctcacccaataccagatcaattttacctccccacccctcccccactccttccatccagtacactttccctcccagtacactttccttccctccctctctacttgttattgctttcttctctctccagtgggactgaggcatcctgtcatgggcacttcagcttgttgagatgagttctgtgtatcttgggtattctgtactgttttgtttgtttgtttcattttttgctaatatccacttattaaataaataccaacatcttttatagatgtctttgataaataagttctgcaaattcctaggtatattcaatctagcctaagccaactttatatatcaaaacttattgtatttattactatatttgtgattaaaagtttcttttgatgtaaaggtatcaatgttttattttttttaatttaattttgctttttgtctgcctccaagtcgcccattcccacattgcttcttcccctcctcctccttctcctctgagcaggtaatgtcctcaactggggtatctcctgcaaccatcgacttcaaatctctgcaaggataggttcttcttctcccatagaggccaggcaagaaagcccagctagtaatacataactcacatacaaacaactgcttttgggataaaccctgttccagttgtccaggacccacatgaatgctaagttacatatctgctacataaaagcagggaggcctagatccagcccatgtgtgtactttggttagtggtttagcctctgagagccctaagggtccagttgatttgactttgttgcctgtggggtctctattcaattcaggggccacaatcattccttctattcttccaaaagagacccccaagctccattcactctttggctgtggggttctatatttgtctgaatcagctgctgggtggagcctctcagaaaacaacatgatcccgactgcaagcctaacagagtatcattagtagtgttagggattggtgcttacccatggctttgatctcaagttgggctagttgttgattgacaatccccttagtttcttctccatcccttgtgcttacatttcttgtaaacaggataaattttgggttgaaagttctgtggttgctttggtgtctctatcattacaatgaagttcctgcctggctacaggaggtggcatcttcaggttccatatccacaaagtaattagtaatatgtaaggtgaccggcaatgattcctgtgcaccactattatcccaggtctctagcttgtcctctagccctcccctgacatctccttactagcatcagttgcagatttccttccattttcatggccaccttgccatctttactgtccttctgcttttcctattccataaagtaactatgcctaggcatttgatgtatatatataatttttttacttaattctagactctgtagaaaactgaaagatgtaccaatctatgagcactaagctattaggaattgactaaatactatgtacagagcaataatcatagatactttccaaggctattgtttctgtatacccacaggtttctggccataatagcaataagagttaagtgttttggagtggacctcatagcctattagaaaactattgagtacattcatgaaattcatgtaacaattgtatcagttggcattttttagcaggacagtcactttaatcactgggattcaaagcctagtgtgattgatttctttcttcctctggtggcatagaactgcttccagtgccatgaaagatatccattagggatcaagcttacagatcaatcctatattgatttcccactgttctataccttaagaatgtagtgtgttcagctaaagggctgtacttccatattccgcagtgtaatcaagaatgttagcaatagcgctgtaatgaataggatctccctggaaaacaagccaatacaaagaggtaacacatttctgctattagattttatatttgttagcctgtagtgtccagtaaagaaatggttattctgttatcagttaaccctattgtttaaatattggtatgtgtatttacatattaaggtcagttttagagtagtcactttccatatgacttattcaaaatgcctccagtattatttatctttctctatgttccctcctttatcctgctcttctattgccctcactgtttaatcctcaatgtatcataattttgctttagccctttataccactcactggtttataaagcattctctttctttaaatgcattcccatacacctttactagtttcctaatctatatagttattccaaatacaacacatatatctgaaaaaataatatcagctttacctctgaatcatgttcttctgtgacataatttcaataactttaagggaacaatcttttaggtgttttgaggtgcacacaaatctgttatttatgtcctcatcttcccaagtacctgtgattatagtcctcctgcattatcagggacactgatattctagctttcaaaattgtattaaatcatcatggaataatgaatggtgggattttaagaaactttaaagttaaggaataacaggaaaaaatcatagaaccccttctcttactaaggcctgtagccaagagataaacaaacttgcaaagtgtatatgatgtcatagttaaatacctggaagcaagaactaaaaattaaaaacttctacaaatgttatcaatgttctaataatttttgttttacacacattcattcacaaacaggtaaatgcaatgtgtttatttaatgacagacatggaatacataggctagctttacattaaaaataataaacaaatttgtaacaaaactatccagtgcttcccaattcttttacttattaattagcaaaatagaaaattcggtctgggcatccaaatcgaaactcaaaaatctacacgtgtgtgaaaatatagttcagaagtagaccatttgcttgtctttaaaaaaagaaaaagccatctttctatctctcacagactgcgttcatgtttttctttatatgcttcaatttgtattctatattattatgcaaaatgtacaactgttataggatctaaccgcgaaacaatatttgttaaaaggtgaggtgtgtgttaacttcgttgtatattttaagaaaatttaaagtcctaaatagacattaaaataccaaagtaagttttattagaaaatatagtattaaactttgtacataataatttttaccatcgatgatttcattgcttctgcataaattacttcacaatggggtgatacttggggtaatcacaaaggaaacttcagtccctgtagttttgccattttttcctctgcagcttctcgctgtctgatggagacattccttatggcgatgttcccttcgtttttacacatcttttaaattatatgctttctagagaataccgactgttgaaaacccactttcaaactgtttcattcccacccccacccccaccccgctcccgcctcctgcgccgcggtcgcggtctctgctttactctcccctccgcaagacctgccacagcaggaaatgcgtcacaaacctgcgcagtggctgtgaggagcctgcggaggaaagacaggcttgataactcagcatagggaaaggctcgggatgaagcaggagagtcggtgaggcgatgggagagcaacttcatagatacggaggggactgagatgcagggggaaagggaggtttgcggagagaggaaacctggaagggggataacatttgaaatgtaaataaaccaataaaaacttaaaaaagaaagagagagagagagagagagagagagagaaagaaaagaaaagagaaagaaagaaagaaagaaagaaagaaagaaagaaagaaagaaagaaagaaagaaagaaagaaagaaagaaagaaagaaagaaagaaagaaagaaagaagaaaagaagcccttgggaccaaaaattcccttctttgaggatttctccgagccacaaatagagatgcacggtcaggctgagttaacttcctgttgtcgcaggagcaccgtgtggttccggattcatcttcagttttcaagttttgataaaatccgaaatcgattagctaatgaattcgcaatcgtacgggttttaggagtctcggctttttctactgagcttcttttctgtagctgtagctttataaatgagccctaagtatttgcttttataaaggaaaggaaaatactccagcgttagcgttaaatcaggtcggcagggacgggagatagccaaatctgctgtttatttttaaagttaaaatatttacattgaattttcaggaggtttgaaggcttaaaaataaaacgttcagcgtgatattcttaaatacactgtgtatgtcttacagacgttttgcttttcgttctaacatccagtaattttctaccaatataatctctaaacaggaatgatacatacatccatatatgtatataagtatgtgtatatgtgtgtgtgtgtgtgtatgcttatatatgatatttacttcagtcacacaatacattttcaagtatcctgccacataatgcatcttcaagtgtttatgccacaaaagggtgtgtgtgtgtgtgtgtgtgtgtgtgtgttaattattcagtactctttttaaaactggccacagtgaagctgtgattatgacaggaaaaggaactttaacatagtcttatggttgggatattaaggttatatcaaattacatcagatattcttgatttatttatagctaaggagtataagaaggaccattggatagaaaatagttaagcactaagagagactctggctgaagtaggatctaagtaataagacttcatctggaaaatggtacagaagaaagacactcagttgtgcatggtcgtgatttctcactcccttaaaaatgattatagtttaaatacacttttatgtaaaagagtacaaatattcagaaataaggttctagatcataaatgaaattgtattaaagaaagacaattctcagatgatgaagttttgtttttattgaaaattgattaatcattcaatatattctaattacagtttcccctccctcacccctcacagtttctccccatctctcctccctctgcatacaccccctttcagtctcttgttagaaaaggaaaggcttctcagagataataacaaaacgtgacaagttttggaaacaatgtctccatagcaaaatggaacttagaggtcaaaattctttggagagtctttcctagaaactgcaaaatgtgtttggcttagttggagggtaatgagggtgttcagaaaaggaaagtatcacactgagcttaaataagtggctagatttgagaatcaatggtactggggaccagggaaaacagctatgtcccagtcctcataacttatgtcctcatgttaactatgttaagccacttaacataggctgacagcaatgtcaccctttttgtatgccataacttatcttcatattttgtatgaattataacactgcttctgaacaagatttagaatttcctaccatgtgtgtgtgaaagtctttcagtaagttgatttttatattgctgtctgtcttgtgtgttatttcattacactatcaagaatagagtcctaaggcgggctatggtggtgcacgcctttaatcccagcacttgggaggcagaagcagttggatttctgggttcaaggccagtctgttctacaaagtgagttccaggacagccagggctatacagagaaaccttgtcttgaaataaaccaaaaaaaaaaaaaaaatagagtcctagagccaagacttttatgatatggttcatatgacaggtttccatggttttgtgtcactgtcatatggtaataaattttcttaacatatctaagtcaaaatattacatttctctagtcttttgtattcttttcatacatggatattcttctatagtctccaacaacatgtttgtattagggcattcaatccttttctcctgagcctgaatgttaaaattagtaactagaatgggtgtttaaaaattgacttgtcactatagcaatgactcagctgttaagagatctaactgcatttccagaagagccaggttcaattttctgcacctaaatttcaactcacaagcatctgtctttagtcccaggagatgtgagacactcttttctggcctccataggcactggagacacgccgcacagacacatataaagggtaatgccaatacacaaataaataatgttttaaatatctaaaaaaataatgtctttcattgtaattggcctattattaagggaaattgagtctacttggaaaaatgttgccacaaaataatgatttagaatttttatcattctacaaattctgatcattctctgtacagtagaactaaatcaaggatggaatcttctatcttagctttctgtgcacctggaaaggtggtgaggttgaaatttcagaactaaaatagaacaacaacaataacaacaaatagctttagctttttattgaacatattaatatttaaaaggataagatcaaaaggctaaatcccaggtcattatcagactcctcaaattctttttacattctttcctctttcttctagtcagctgggttatcactgctggagggggttggaccacctgctagtgcctttccttgtgctgtggaaagatcacacctctacatcacacttctagatggggatccaaatgtttacaatgagcagagatactacaaacaagccaggccagtaaggcttaatattgaaatcagataatttaatgagactattaatcaattctcttattgatcatcacatcatagtgcagtacacaagcaaaatagatgaaggctatatacttcaggctactgatccaatgctaatcactggataaaatgattgtctcatgacaaaacaactttatttccgctgtaatcactgagcacctgtgtggcttcataagaagggtgttaggaccttctccagcttcctcttcatagctcttctctagggtgtccctatatcattccgccctgggtaagggctccataaataatagccccctacttagttgtatgctgcaagtggcccatctcctttctctgctgtatactaatctcactcccttcaatctctccttcctttgagctggtcacattctgggctgatactgtatattctgaagataaactgccctaaaatatgggacagctgcccagccatggcccttgctcactcactggtattgccttccctgtagtattcaaactaatactttctacttgggttgattatcctgaatgtcacatgtcttgattgtaatttcttccagtttcttgattgtaaataatcattgctgtttttattgttaacagtgtaattccccccatctgcttagaaaattaaggatagctgaactctataactctctctctttgaacccacaaagtcttttacaatcccattggatttgtcactatcccttgtgatgctccctattttctgagagtataattctgctatgtaggggtagaacaactgtgcaagggcatatgtgtggtaggggtggacctgggttgatcttttgttcccccgtgcatcactctcaatcctttgtgaatactgtctgcttaactgatatttcgctcctgtgtcaggagtctggggagtccactgaatccttaagtttctttcattctttatctctttgccagcttttttattattattctactaaatatcatggcaaagatcaacaggaacacattgtattttcccttcatgtttgtagccaaaattctatagcaggtcctttcctaatgtgcaaaactatattttaagaatgcactagagaatatgtcagtcctctatagctttggaattggcaggagcctgatatagctatctcctgggagtctttgccagagactgacaaatacagaagcagatactcacagccaactattggattgggtacaaggtcctcaatggggtccccactagaggagtgagagaaagaacttaaaaagctaaaggggtttgcaaccccataggaagaacaataatatcaaccaatgagaccccctcccccaaagctcccagggactaaagcaccaaccaaagagtacacattgaaggacacatggcttcatctgcatatgtagcttggtcatatgaaggcaggagagtgggtgtgggtgggtgggtaggggagcactctcatagaagcagggaatgggtaatgggatagggagttctggggagactaaaaaaggggattacatttgaaatgtaaataaagaaaatatctaataaaacattttaatgtcattgaatttcctcagagaaagtgaatgtgattaaaacgaatgagtagctaaaatcatgcaaattaaagctataaaagacaaagaaaggattactgatggtattattgtaattaattgtaaataaattgacaatacacaaggagaatatgtggattttttttttataacaacaggtgtgaattccatattttttggtgtggttccttttgtctacattaaaaagaaaacctactaaattattgacaaatttggatttcagagactaggaatgttggatgggggaagggaaagagaagctagaagaagatcctgtataaggaaagaatgtttataaaatagtaaatagaacaccttcctaagtctaagggaaattgatcacaaaagagaatatactttcagagatcaacctttttttttttttcctttttccttttcttttgcctgcaagtgtctgtaaaaaagatcctaagaaaaaacatccattctctctagttctgaaagaaaacagttctggttaaagttcaggtttcattctaaccttaaaggcagttttcagaattccatggctcattgtgttttaggaaatcagtgactcccttgtgcacaccgccatctaccgtccaaaaattgaacatgcctgagaaaaactcatttaaaagtccttgggtgttgttgttgttttatttgtttacatttcaaatgttttcccccttctcggtttccctccacaaaccccttatcccgtcccccatacccctgactctgtgaagatgcccctcccccaaccacctacccactccaacctcaccaacctagcatccccctatgctggggcctccccaagaacaagggcaggattaggtataggggtagataggagagaggtttaaagacctgaaggaatgaatggaaatatgcagctgccaagggtaggagtgggggtgaaacactaagaagtcccagagacctgggatccaggatgctcccaggactcagtgggggttgccataccaaaatgcccaacactgtggatatggatcctaaagagaccacctccagtagtcagacaggacccccagtggcaggatggagacaccaacccacctacacaacttttgactcaaatttgatcctgtctaaaagaagtgcagggacaaaagcagagcagagattgatggaatagctgaccagtgacctgcccaacttgggatctatcccatgagtaggcaccaatccctcaaactattactgatgtcatgatgtgtttgcaaacaggatcctagtgtggctgtcctctgagaggctctagcagctgcgggctgagacagaagcagatgcttgcagccaatcattggactaaggtcaaggacccttgtggaagagttaaggaaaggattgaaggaactgaagtggatgcaaccccataggaagatgaacggtgtctgctaacttagacccatgggaaatcccagagactaagccaccaaccaaattgcatacaggggctggacaggggctcctgtagcagagggctgccttatctggtctcagcaggagaggatgtaactaatcttgtagagaattgatgcctccaagtgggggtatacagggaagagcacctctcagagaccaagggagagggagggaacaattctttgatagaaccaggagcgggtacaaggtttgggcggtaaataaataaattagaaaaagtccttgggggagatggtggcaaaggaacaaattactgtgatcagtatcactgaagttttatttgatttttttcacaattgaaacgtgatggataattgcttgaacaggaggatccacttcataattccttgtaaataaataaggattactaggccatgccatcttaatttcttacacatgctatgagtgataacagccaaagtgaatattattagcttgtttttaattttgtttgcaaacatgaaataacaagagttatctatgtgaggaaatttgtagttcatagttggctgtaaaaaattatttagttgaccttttgctaggatatttattcttgactcactgtgtgtggaatatttccataaatattatttttcttcagtttctctatggcttacaaaacaaagaaaatctcttaagataaagctttcatatttttgtcagtgtggcagatgcaaaagagtcatctgtgtatctccatactgaaaactaatggatagttgtaggagtggagagatccaattaatggttccttataaagaaataagggattttgtccatgtcctgttttcctgccacttctgccacatactacgtgtgctaacagacaaagtgaaaattattatcttatgattatttttatgtttccacaaacatgaatcaataagtgtatataagcatgagcatatacacatttcattctttactgtgccatttattcagttgtactggttttgtgatatttattcttaactgattgtatgtggtatactaccataaatatttttgtcattagctgttctatggttcacaagcctagaagaatttcttaagtcaacctttcatgcattttggctgtttgatatatgagaaggagtggtctgtttatttagtacaatctccacatggtgttcaggcccttgatatgctactgaaatcagtttccttcagagctggaaaggaatatttttcagtgttgtttccattttgctgaaagatgaatattcttggggatggtacggagaacctaacaccctatagaaagaatgtgtactgtattagggcataatgagaaataaaggagtggggcataatgagaaatagagcagtgacactctcctgttttactttctgtgtttgagtcagtttaaacaagctcctggaagttcaccaaaggtctcatatactgatcagtctttcagcaagcagcccaaagcaaaaatctttactaattttttcttctcaatttttatctttggtctttattttttctaaatattagattggttagatattttctctttaaaatatgtagtatttggtttgtaaaaaaatgtaatttctatgaaattatttttctttccttcctcttcaatactaaagatttgcatttattcatattcttttaatctgaaaactaacaattatatgtaatattagtgcccattcattttttgaagctgtattttattttcttttattttatacttctttggcttcctactgattcttttttattttgcagtctgccagtgaattaatttagtaggaaattagtacgttcaatgtgagtaacttcttgaaattgtataattttaaacggtaatttataatgagtgtttacatgtgggagaatgtttgacatttaaagaattgaaaaaaaaaagagaatcagaaaaaaatcacatattcattcaaaaatatagctggggacatgaacaacgggagtgttttcaagagaagaaactaaactgataagaattatgtaaaaaaatatttgttgtcccgtgtaagtaggaaactgcaatcaaaacaactctgagatttttccctctcaggcagcatcaattatatatgcagcatcaaatatatatgctaacatcactcactatcctcatttataaatgcttgctcagtcacatagctgctctagtcacaaaatcacaatagctaggaagtggaaacaacctaaatatctttcaactgttaaatgaaaaatgaatatatggagagagagagagagagagagagagagagagagagagagagagagagagagagagagagagaattgtgtatgtgatattgttcatctgtaatgagaaaggaaattatgtactttacaagcaaagataaatagacctagaaacagtcatattggatgagattccccagaccaagacagacaaatctcacattttcccttattggagacttctatctcctcctggtcttcagatgtgaatacataccatgaagtaacagaagaaataataaaactaaaatggagttatttctgcagtagatgattgggaaagcagagaggagagtacagctgaacacaagtgatatgatgggaaaagaaaagggtctttaatgaggaaaaggaatgtagacaaatacagaaaaacaagtagggggataaaagaaaagtgagggtgtctgggaaaattgttaaaaatcatactattaattatgttctggaagtaaggaaaaaaggaagaaaaggaagaatgaataaacaaaaaaacaggtgggaaggaagaagggagggagggaagaaggaaagaaacaactatatcacatgtctgtatgtaaatgtgcatatatagcatacatgatattttgttattttggctggcagtattccttgtggtaaaatatcacctaataaaaaccccaacagtcaagaggagaccaattttgaattattggtcaaggttgtctaattgactccccaaaccaaattatccaagtctagtcaagccatgaattttaagaacataaaatcaccattctactaaaccttcataattccttacttcaatatatagatgtgtctttatacccagttcagaatataggtctaatcaaaagaagagtacatatcagatctgattagtattattctgtccaaaagcctaaggcatggggatttaagtagctcaatggtacaatgcctgaccagtgtataagaatttgtgggttgaaatcccagaatctcagtgaaaattaatttgtagcacaagcatgatagttcagcctttaaaacgccctcaagccaagcctgcctagcagagttctatcccagaaaaccttatgccaaagaagagaatttacttccactagtgtcccttggaccaaagaaatacctactcccataaataaatgaaaatttaatgacttaaattgaaggacaacaaaaccatcagtttatcagtaatcatgctgactttgcccctccttagaattgggaacaaaacacccatggaaggagttacagagacaaagtttggagctgagatgaaaggatggaccatgtagagactgccatatccagggatccaccccataatcagcctccaaacgctgacaccattgcatacactagcaagattttatcgaaaggactcagctgtagctctctcttgtgagactatgccggggcctagcaaacacagaagtggatgatcacagtcagctattggatgggtcacacggcccccaatggaggagctagagaaattacccaaggagctaaaggtaactgcaaccctataggtggaacaacagtatgaactaaccagtaccacggagctcttgactctagctgcatatgtatcgaaagatggcctagtcggccatcactgcaaagagaggcccattggacttgcaaacattatttgccccagtacaggggaactccaggtccaaaaagggggagtggctgggtaagggattgggggggggggtatgggcgacatttgggatagcattgaaaatgtaaatgaggaaaatacctaattttaaaaaaaggaaaagaaaaacagagttattttcagacagatttattttctgatcatggttcctcccttatcatccctcattttgtctctctgtagaaaatatataggcatattaaaaaaaaaaacaaaaaacaaaataaagtaaaataagagagaaagcaccaaaatcacagacacacaaagatgcatgcctttacacaaaccccataaaaatgcaaaattcaaatcacaatataaaagcaagttactagtgaagaaaatcaaacctaggatacccaagatataagatataatttgctaaacacatgaaactcaaggagaatgaagactgaagtgtggacactatgcccctccttagatttgggaacaaaacacccatggaaggagttacagagacggagtttggagctgagatgaaaggatggaccatgtagagactgccatagccagggatccaccccataatcagcatccaaacgctgacaccattgcatacactagcaagattttattgaaaggacacagatgtagctgtctcttgtgagactatgccagggcccagcaaacacagaagtggatgctcacagtcagctaatggatggatcatagggctcccaatggaggagctagagaaagtagccaaggagctaaagggatctgcaaccctataggtggaacaacattatgagctaaccagtaccccggagctcttgactctagctgcatatatatcaaaagatggcctagtcggccatcactggaaagagaggcccattggacttgcaaactttatatgccccagtacaggggaataccagggccaaaaagggggagtgggtgggcaggggagtgggggtgggtggatatgggggacttttggtatagcattggaaatgtaaatgagttaaatacctaataaaaaatggaaaaaaaaaaaaaagaaaaagacaaagagaaaaaaaaatgcaaaattcaaatcacaatataaaagcaagttactagtgaagaaaatcaaacacagaacattctgagttaactaacaaaatactgtcaaaatagcattgagttcatatgagttagctggataaaacttgtcatgaggcttccatctgagtgtggtttatatccccgttgattcatcatcagtgtaaactagttttcctttgggagtagtcatcaactggaggtagcttcctggtcagaagtgatcaattaggtcgacttccttctcttggcactgacttgaatctctgcagatcctgtgtacgctgttctgatctatttgagtcagtcttttctttatgtgtttatatttcaaatgttttcctcttttccagtttcccctccaaaaccaccctatcctatccctttccctgctgcttctaaaacagggatcccactcccacctaccgactcctatctcctcaccatcctggtattcttaatgtgcctggaaggcattgtttccctggttacattcctccctgccccactggcaattagaatctctgtaactctcttctgcagtttcctaaccatacaatggactttgcatagatatatctcatttatgactaggtgatccaatgtctctcattctatgtacattgtccagtctaggtttcttttcccatttgttcccatctactacagatggcagcttctctgatgaagcacggattaatgggttatgacaaaatgtcattaagaatcattatattgctttatttcattagaacaagattatttgactttctcctatgttcattaattacttagttccatatgtttggatacaagaaatattttcgttcttgtggagtgggccttaaatccaatcataaaatgattgttcacttccacaatatttctgccactattttaccattgtatcatataggtatgtcatgattgtagatcaaagaggttagaattgggctggtttataaattaatttcaagaatgcatgcagaatacttcacagtaacatcattcctattcgggtggagtgaagatttcaattaggcacatgcttgatttctctgtattcaatgagacaatgagggtattgttttcctcaacagggccatgccatcagtttgtgttggtaatagcctgacttgtttgagtgtttccatgaagactctttgtccaaaaaatcaattatacataactcatacctatgataaaaggttttatttaatgagaaatgagtagttcagggattctttcccagttatttagttatttgatttatattctcatctctatatattaacatgtctactgtactagattactataactccttggagatgatccacggttctatttttccatctcagtattccatccctatttatccccaaatttatcatctctccctattgtcttcatttttatatatgctatttctacttccactagaaatccttccctcccttctattatcttttgctataccttacctttgtgaatttaaggattcataatgcttttgtgaaacttaaaacttaatatttaactatgagggaatatattcatatttgtctttaggtttctgggtacctcactcaggatgacttttcttcaatttccatccatttacctgtgagttccataattgtattttttaacagctgacttatattccattatataaatgtaccacaatctcattattcattcactactttttaagacatctagggtgttttctatttctgactagtatggatagagcagcaatgaacatgggtaagcaaatttctctgtaataaggttgtagagtcctaatggtgtatgcccgaactggatcttggagtagaactattcccgttttccaaaggaacctgcacaatgatttcaaaagttgctgtaaaaattccatttctaccatcaatgattaagaattcccctttctctgaatcctcaccagcatctggtatcatttgtttatggatctttgttatcctgattagaggaggatgaaatctcaaagtggctttggtatgcatacccctgataactgtgaatgctgagtactttaagtgaaaccagcatttgaatggccacttctgggtcattggaggaagcaatttataattgaatacacagagataagtaggagggtaagccatggaaattagaactaaggaagacaatggaaggattactattcaaagagtaactattgagggaaaacagccaaattgcatgagacatgcaactaagggaaataataaacaattttaattcatctcagtatgtgtatgtgtgtgtgtgtgtatatatatatatcaattacaaatatatatataatgtatatatatatgtatatatatattacaatttcttgttttatcattaaaatggaggtcacccagctttagaatagccctttataatgaatttatagaacctgtgctgttgactggtgagggatggtaaaaactttaaatttagagttagattttaggtagagagagtaaaatatatgagagtagcaaaaggaaacagactacaggactacagcacaagaaataagccaggggaagatgtgttgtaggtgcagaatctccctttagtctcaatagatctcatgttaaaattaccagaagaaaacatgttatcttcacaatagattgcatccttgcccttataaccatatgccaagcttgagcaagtggttacctctgtactcacagagccatctaacttttaacaaaacaaaaagattgatggaaacctcttcaaaaggggacagggaggggaagaggggagtgtgaccagttattgggtaggagaaaaggactgaagccctgagagccagcaaagagtggagaaaggcaaccctggaaggtaggaggtggagggatcctccagaatgtaccagagacctgggagctgagagactctcagaactcaaagggagggaccttagttgaaatgccctacagtagggagagggaacttgtagagcccacctccagcacaaagcagggcattaagtgaaagagggtttgcaatcccacagtcaaaaactctgacccataagtgttactgtcctaaagaactacaggggaataaatagagaagagcctgagataaaggaggtccagtgacaggcccaaattgggatccagctgaaggggaggccccaaggcctgacactattactgatctatggagtgctcacaaaaagggacttatcatgactgccctccaaaagacacaacaagcagctgaaagagtcaggtgcagatatttacatctaaccaatggacagaagctgctgacccctgtggttgagttagaggaatcctggaagaagctgaggctaccctataaggaggaccagcaatctcaatttacctggacccacatgatcaatcaaacactggaccatcaaccaggcaacatacaccagctattacgaggcccccaacacagatacagcagaggactgtatcaatcagagaagatgtgcctaactctaagagattggaggccccagatagtggagttgtctattggagtggggatggggggacatccttgtggaggcaggatggaagggagaaggtatgggatgttgaatagttagagggtggactgggataaaatctcaagttaaaaaaattcagagacccaagtataaaaaattgctgtgcttatttcaacaggaattaaattcatttcaacaaaatttaaatctcaaatcccaaatctaatgtcttatttctagaggagatatctaatttatattagctttcagaacatactgtgtactgatgcaagacactctttgctgtcccatcatacatagatgactaaagagttaaaggttaataaaaattctttgggtctgactgattaaagaacagatacagagagaaattttaccattgcacatacaaaatgaaaatttaagagtgaaacaaatttaactgaccattgtacatatgttatttttgatccagtattttcttgcacacacatttcatttcagttacactagaattcatataatcaacatttcattggcccaaggtttgagtctaattgcctttaaaacattcttttagatgtttctcaactgcagaatggataaagaaaatgtggcatgtctacacaatggaatgctataaagctattaaaaatcaagacattatgaattttgcaggaacatggatggaacttgtgaacatcatcctgaatttggtaaccaaggctcaaaagtatctggatggcatgcaaccgcttataagtgaatattagccataaaatataggtactatgctacattccacagacaaaaagaataaagtagggaggccagttcgggaagcttgaatctcacttagaaagggaaataaaatcgtcataagaagcagatggatagaaggaaatggtaggcatagagatggggaggtgaaaccaaggctcaatatcaggtgtggggaaggacaggagagatgcctagatagccatgaaagtgaatggaaatctgtaactgactgcggtgaggaagggggccatcttcaggacaagacagagttttaggataagggagacaccaaagaatcattgtgggtggccttaattgtaacacactacacaggggatatggaacacaaagaggctacatcctatagccagggaagaacgccagtacaatgatagagataaaaaacaaccataaaactttaaacccaaaatttatcctgtctacaatatctccaacccataattgttcctgtgtgaaagaattacagggatttaaatggagaggagactgagaaaaagagggttcagagacaggcccaaagtggaattcagctcaaggggagttcccaagacctgacactgttactgaggctatggattactcaaaaaggaacctagcatgactgcccctccacaagatacaactagcagctgaaagagtcagatgcagatatttgcacccaaccaattgatagaaacacctgaaccctatggttgaattagggagggctgaaagaagtaaggagaagggccatcctgtaggcggaccagcagtctcaattaatctggacccctgagatctctcaaacactggaccactaaactgacagcataaaccagctgatatgagactcccaacccacatacagtagagaacttccagttctgtgttcattcagagatgatgtacccaaccctctagagactggagacaccagggaatttggaggtcaggtgtggtgaggagtgtggatatccatgttgagacagggggttagggaggagtattaaatgtggaacagtcagagggtggattagggttggggtaataaaatatggaatgttgaaaaaatattttccaactattttttaaaaatgaagatacaggtgatgggctagatactgaggagatgaccaaccaataatgagctcatcttaagatccatctgctgggcaagtaacagtctattaatagattctctggtatggttgcagataggagcaagttgtcctctgacatggtccacccagcagctgacccagaaagacacagacacacacagccaaacaatgggtgaagcttgtggtctattatggaagaaaatggggaagaattgcagccaataatgggatagaaagtacacagaaaggacaccatagtcaactaacctggacccttgtggctctcagaatctgaaccactaaccaaagtacatacttgggcttgaactagacctccccttacataacacaagtaacagatgtgcaacttggtcttcatatgggtcctggacaactgaaaaggaggctaactcaaaagccattgcctatatgggggatgttttcttacagctgagctgcttgtctggcttcagtgggagaggaagtgccagatatttgaaatgccagattgagggggggaataaaaaggaggacctacctgctcagagaagaagaggaggcaggtggggcaggattgtataagaattgttatactagtgagatgggggcactagtgggatataaagtaaataagcttaataagtaataaattaaattttaaaaagaatgataattttttcaggagtcctaaaatcacgtgggtttttcttttttgaaactgatatatattttatctgattctcaatatcagcataacaaaaatttaaattagacgtagaattattttaacattctctttcactgaaatttatgaaacaggtgattttgggatggtgaagtatcaagttataattcaattaggcaacaaaataagagccagggaaagaaaaaagtcctagtcttcataacttgggccaacaatcaaatatccctatttacttgtcacaacttatgttcatatagcctttatattataaaaaggcttacaaacaaggagatagcttaagattggatggcaatgtctcatttatgagaggagaatccatggtctttcactctgtatattgtccagatatgggcctttgtatctggccccatctcctatatatgctagcttctgtgatgtcaatggagcaatatactgatctatgggtttaataacaaaatattattagaagtcaatgtgttgctacatattgtagcagacaatagtacctgcattaagccttagacttgggtactttaacatgagaataatgtcaaatatgtattctgtctcattgtgtaggtctcaaatccagtcagatagtggttacttatccccttgaaggggccactatcacagcagtgtatcctgtaggcagctgagtgtagtagatcaaatagtgtataactgggttggtgtgttaagtttcccctcactaaccatacagaatatttttcagtaccagcaaatctattcatcaggcaaaggctttagttagacaaatgcttgtcttctctatgttcaaaagaaatgtaggtgttgtcttcaacaatagagctatgctcagtttgtgtggagcaatcagtagcttaggcaatggttcgatttgtttggggtattaccatgaggacacattgaccaagaaatatattagctataacccatatatgggattgaagctttcatttggtggcaagggatgtctagttgggtcattcctattatttggttattctttaagatttttttttatatattacatattttagatgttatatattaagtctactgtggtagctttcagactgatcatacttttaggtgctccccttagtattccacttaatcctcttcacttcccccctatccatttaaatgccccattccaatatcacctccgaatagtcgcataattatatattatttctaaatcctcaaaaaattcttccctccatcctaatttttgcatgcctttgtcaaggctttaaatctaatatccaaatataagctaataaatactatatttgtctttggggttctgggtaactcagaatgaggtgtttgtttgtttgttttagtttttgttttagtttttgtagttccatccatttaactatgagtttcattattttgtttttttaacagctgtgtaatattccttttataatataccatatttttattatcaatttctccactatgtataggtatttctaactactgttaataatacagcaacattgaataggaactagtaaggaatgctataatatgatatgtactcccttagatatatgcttagcaatgatacacctggaacttgagatataacatttccagattcaaaacagaaaaccacactgattttcaaagtggcagtacaagtgtgtattccaaccagcaatgcataaggattcttattactcaccctcctcaccagcatatgtggtcattcattttatttgtcttggccatactgattagtgaaaaataaaatctcaacatggttataatattcatatttctgattactaaagttgttgaacatttctttaagtgaaaccagcacttgaatggttaattatgtataattagaggaggagatttatatttaaataccaaaaggataagtaggtgaaagacatggaaattagaagtaccaaagacaatgaaaagattagtatccctagagaaaccatagcaaagagagcacccaaaagcttgaagcatacttcagttggggatattaagcaatttcaacacacacatacaattttctgatttcattgtcataaaagagccagccagattatgaatataaatttgttaataaatttaagtaacatgtaattcataagtgggggatgagaaaccatgaagtacaaatatttaataggcaaatatttaatagggaagatacaaaatctgatagtagggaaattagcctacttcaaagaaaattgtcgttaaaaatgtattctcacagcagaaagtcccttcaatactcacagatcctagacacagatttgattcttgtccttaaaacctgaagccaggtttgaagaagtgattatgtctgtgctcacagcgccatctagctttcaacgaaacaggaaggttgatggaaacctctacaaaaaagaaaacaatttcaggaggggagaggagggagggacctggatgggaaagaggacaggggaacatgatctggtatttggtggagggaataaaactgaagccctgaaagccagcagaaagaatgggaacaggcaacttcaggaggtaggaggtgggggaccatccagattgtatcagagtcctgggagctgagagattctcagggctcaaaggaaggaatcttagatgaaatgtcctacagtgggaagagggaacttgtagagcccacctccagcagaaagacaggacatcaactggagggatggggttgccatcccacagtcaaaaattctgactcatatttgttcctgtcttaaagaacttcagggacaaaaatggagaaaagcccaaggaaaaggagatccagtgataggcccagagtgggatcctgcttaaatggaggccccaaaaactaacactattactgatgctatggagtgctcacaaaaaaggggcctatcatgactgcccttcaaaagacctaacaagcagctgaaagatgcagatatcagatgcagatatttacacccaaccaatggacagaagctgctgacccatgtggttgaacttgggaaaagctggaagaatctgtgtaggagggtgactctatagatgaaccaggagtctcaaatcacctggaccccaagatctctcagatactgagccaccaacaaggcagcatacaccagctgatatgaggcccccaacacatatacagcagagcactgcagggtctgtactcagtcagagaagatgcacctaacctcaagatactggatgtccagggagtggggaggtctggtagggtagggttaaggtgtatggatattctcatggagatagtaggggagggatatgatgtgaaacagtcagagggtggatgggggaggggtataacatctggactatagaaaaaaattagataattttttataaaagcatacagatagacccaagaatattaaataccaggtttttttttctaaaaacgatttaaagaatcatttcaaagccaaaacctatactttatttctacaggggacatctaatgtactttcaccttcagagacataggaagaatgatgcatgtctctgttagctgccacatcacatttcaagcaaattctaacaatagttaaaattcagttagaacactttcatgctgactgacagaaataatggctggagagaaatattttgctatgagtacatacatagtagagatttaaacgtgaaagtgatttaattgaccattattatgtgtacgtatttattcttcattttgtatggacatattctcttccaaatattttttttaatttcagttaccctctgattcttataactaataagactttattaaatgaaactttgaagctggaagaatggcaacacacactcatgaaggaaatagcagtatttctggcaacagtaattgaaaatgccttctttagcaatgaaaattaactctaccagattggcccaggacatgtgctaattttcattagggctgaaaaactagatctgtacaattgtggtggaagtctttctgaaaggaagacagttctcctggcaggtggattctctttgtttctcagtgcaggtagtgctgagaagccaggatgaagatagcacatccctccctaggtttctttgttttctatgtaggacaaaactttccctccttaaatagaccactcttcaattgctcctcatagggttattgcttatcaaagtcttcaacctgtatcccagcattaaaaggactctatttagattgcttgtttatgttgaagtctttgctatctaacttcctactaacatctgataagctaagtctttcctaggataaataattctgtttctagagtgccctttggtctttagttacaaaaagtatgggtttaaacgaaaactttgaaatctcattagtcagtttcagtagtgttaaatttctgttattttacatttaagattttctactatttgtttttaaattcttctctcattcattacaaatcctatgctttcccctcccgcctctccatgcagtcctcccatatctttcctgtcatccacatctacctctccaaaatagtcttcaaaaaacaaaacaaaacaaaaaaagagcaagtttttcagcgatatatcaactaaacatgtcataacatgttacaattaaactaggaacaaacctcctcaacaaggctgggtgaatgaattgttgagtgatttaaatgttctggatgacctaattcaaaggatgcattagatgtccttgttacaattattgtttaatctcattattggactattttgatgagagtatttagaaatagagcaaattatgaaagatgctttctaggcaataccaactggtataaacgcacattaaagttactatgtccattacctttctgtaccctccaccaaaagcagtgacctgagccagtcagtagacctgtgacaggatgtcataaaagcactgcacaattacacctgcctctggtgactgaaaatatggtgaaactacaaggaccaaagttccttttgggttcaacctccactggtgtcaaaaataaaagtcacccccatcgtctttaagttactctggtcactggagcataaccaagtgctttgacttttcatatttcggatattgaatttcatcattagaatcttgagttttcaataatattaatagtagacgtcctgccattttatcttaatcttgttttctttagacatagatttacaaatgtgtactatcaaaagttttgcttttgtaaatagtgacacaaagagttcagtattaattcagggattaagaagtcatgagttaatttagtgcagagttctatcagaacttcaaagaagatctaatcccagttcttcacaaactattccacaaaatagaaacagacggtactctacccaactcattctattaagccacaattactctgatacctaaaccacaaaaagaccacacaaagatagagaacttcagaccaatatcccttatgaatatcgatgcaaaaatcctcaataaagttcttgctaaccgaatccaagaacacatcaaaaaaaaatcatccatcctgtccaagtaggtttcatcccagggatgcagggatggttcaatatacggaaatccatcaacgtaatccagtatataaacaaactcaaagacaaaaaccacaagatcatctcgttagatgcggaaaaagcatttgacaaaatccaacacccattgatgataaaagtcttggaaagatcaggaattcaaggcccatacctaaacatgataaaagcaatctacagcaaaccagtagccagcatcaaagtaaatggtgagaagcttgaagcaatcccactaaaatcagggactagacaaggctgtccactctctccctacctattcaacattgtactttaagtcctagccagagcaagtagacaacaaaaggagatcaaggggatacaaattggaaaggaagaagtcaaaatatcactttttgcagatgatatgatagtatatatacgtgaccctaaaaattccaccagagaactcctaagcctgataaacagcttcagtgaagtagctggatataaaattaactcaaacatgtcaatggcctttccctacacaaaggactaacaggctgagaaagacattagggaaacaacacctttctcaatagccacaaaatatataaaatacctaggcgtgactctaactagggaggtgaaaaatctgtatgacaagaacttcatgtctctgaagaaagaaattaaagaagatctcagaagatggaaagatctcccatgctcatggattggcaggatcaatatagtaaaaatggctatcctgccaaaagcaatctacagattcagtgcaatccccatcaaaattccactcaattcttcaacgaattagaaagggcaatcggcagattcatctggaataacaaaaaacctaggatagcaaaaactcttctcaaggataaaagaacctctggtggaatcaccatgcccgacctaaagctgtactacagagcaattgtaataaaaactgcatggtactggtatagcgacagacaagtagaccaatggaacagaattgaacacccagagatgaacccacacacccatggtgacttgatctttgacaagggagctaaaaccgtccagtggaaaaaagacagcattttcaacaattggaccaagtttaaaatgaatttttcatagaatttttgagaggtttgtagaatattttaaaatattaatttcaatctgacttcttaaatacaatgtgtatgtctaacacaggatgtttgaatcctacagttttttaaatacttttgccaaaatgactgtaaaccaaaatatgagaggcaaacttttatagcagatatttactttagtgccacattatccaccttaaaatattataccaattaccttatgtttgcatgtgcgctctcaattattttaagcagtttgtgtttattttaatactaattacaacttttacaatgtcagtaaatctgttatttatgatagcaaaagaaacttcaacatagtcttcttgagacattttggttgtatcaaagtacagcataggatcttgggaattcatttatagccaaagggcaagtgaagggccattggacagaaaattattgaatactgaaaagactgtctcaagaaggatcagagtgataagatatcatgttgaaagtgggagggatgagaaatatattcagatgagtatggtggtggattaacctaagcatttctcaggacagcctgagtctattgcagagtaaaggtaatataagatctgttaaatagaaagtattgacttgaggctcagaagacactttgaacttttaacactattcactctctgaaagacaatgagctcttttaaagttttacaatatacaattttattatgatatggttgtgagactgtgataataaggtgtacagtgaagtgttttgaatgagatgcccactatttgtctcgaattttcaaatacttgactcctagttgatggctgtttggggaagattagaagatgcagcattgctggacaaaagatatccctggggatagctttctatctttcaaaaatctcatgatgtttcaaagagttctctcttcttcctctctgtggtttgaaatataagctgctacttcagcaaccagctgcttgccactcaaatacagaaagactggacataaccttttgctactataattttaattttattatttattttttgttgttaatacagggttcaaaaatgtaatcctggctgtagttaaacacaatatgcactccctacatatgccttaaatatatgtgccatgatgcctggtcttttttcactaaacttttaattgtaaatataattaatgattaaagccaaatgcacatttaaaatgaaaaaaaaatgattcattgtatattggcttacgtttgtaatcatatcattcaagagatacaaacaaaatgattactaaacgtttgatactatccttggctacagaatgagactctttctcaaagttccaaaaataaagaaggaaaaaataagtaaaggagaagacgaagaatgagaggactctaatattcagatacaatgaaaatctcaagagacatgagttaagtcattgtcacatgcaaactagaattctttggtatgtgaatgagtgagctttggaaaaactgagcatataaaattagagttctctcagcaaaaacaaaaacagtaagtacacagtaatgtaccctgctctttgggtcaattttgagatctattaatttcattttgctacaactcttctgagtgcccatgttacattatcattgaattcagcaatataagtcctcttcactatatagatatggtaatcagtacacagaaatttatataagttgcaaagataatactgtcaattctataattagaatcaaatgcagaaaatttaaatgcatgatatatatacatagaatatcatagtatagattacatcgtatatcttacacaagtttttatccttaggtattattgaaatagttattctctctttcaacttgacgagatttagactcataagttagacaagcttctatcatgattgagtggggttagcttaattaacctaatttaggtagaagaacctgtccttgtgggtagcccaaagttgaggacccttagcactgtcctcttcactaacaagttggatttctgtgtcccaagcaagaagtctaaaacccaaatccagggattgacacttctacatacatacagacaattactcattttttagataaaaaagtaatttatttaaaattataggactttctctatgtgttttcagcatcctaatgccaccttgactcttattatattaagagctgcaaaatgtcttggattcattttctttttgagctaaccatacataatccttgacttttgtcactattgtataaaatctgtaaggtagattaactcatgatacaacaatcctatatcttaatatgctaggagacagatgaaaatagaacgctttaaattcaaggccaatctgttctacacagtatctccctggccagaaagtgctattgatgcaaacattgtctttaaaaattaataaatcggtctgtcttattgagtacttgtttcaaggcatcctctgacaactttcatatagacaacactactgcattgtagtttcattgtctttttcctactaggaatctatatttgaaaggtatcttaaaagtgcaagagacacacaaagacagagaaacagagagaaaaacagacagaaagagagagaaagacacagagaaagatgtatataaatggttaaaaataatgaaatctaggaaccatggtgacatatgcctttcttctagcacttaagaggcagaagctggatgaactctgagttaaaagcaattctcatctaaaaagggaggtcccagtccagcaaattctaatgaataaaacaccgtttcaaaataaacaaatgaaaataaatttaaaagtacatcatagtaacatttatttaaaaacatgaggaaaaaaatttcatcactgaatgataaaacagtgcttttaataaacaacaaatattacgttcacgctaagtgtttaatttacgtgaacacataggaaattttaaagatacacctaattaagtaaaacctgattaatgcagaatgttgttaaagtagcaccttttaatagatagtgatttctcctgatggtactacaagtatctaccgcttttggactttccctagtttgcttacaatttttctaagcactctttctttcctttgtatagagatatgaaggtgaatataattcaatattatgtagtcatcattgcacagaaatcaccatgagtatattcctgaccaatttatgtaagggtttatgaagaccctcctctttcatactagcaataggacagcttacagctcatggccacctgcttttgtcattagctttacaaaagatttgaatccctgcagcctggcaaacatccacgcatgcgtgattggaaggctgtgcaggctctctaaaacaggctgggggttgggagtgtgatttgtcaagtcagtgcagcaggtcctgctcagagaagagccagccaaagatgcctgtcacatccatcctaggaatggtcagcaaggcaatacagcaaataaggttagctcccactttgaccccttgtttctttcatagtagattcatagtagaacatgatttgtgcacattaagtattgcaaatttgttaggattagaacactattctatagatctcaagtctttagttgaagaatcagatgagaaagctatgagatcattacctggcttcctttgtcctgtcctgtgttgtgttgtctgtggtgcccctccccttgagccttcaatctgccctgtcacatcagctcagttctcttacagggtgaacattaacatttcaaagagctgacagtactgtggattattggtgtgtaggacaaagggcagtcaggaagaaaaaagaacatttatatttacagggatgtttcataaaaataatattcctaagggaatttaagtcagattctgccatgccctgaaggatgggaagggataaaagcacttgagggttaacatagagattatcatcagagggaagacacaacagataatggtaggtcccagtttccggatggaaaggatgatcaggtacatatgacttttgacactatgatacctataacacaggaatgaggagtccaaagtggctttaagaaagagtagtggagagtaaattcaggtgtgtgaactaccaacatatgaaaagatgggatatctttcacacacacacacacacacacacacacacacacacacacacgtgtacagaataaacatttttttctgttatttcataatgtaatctaatttgaatgcttacagtcctttactgtctttagatatttgttatttatttatttatcatcatcattattattattattttgctatgttgttcagattaaacaataaactagtgaattagtaagaacattctttggatatgtaatctatttttttattttgctttgtcccctcatttgattgaagtttataagatattcaaaatagcatggtgattttttttttcattttccatcagataaataggaaagagtgtgtgttgtcttttgtttttgtttgtttgtttgtttgtttgcaggtgtttttgtaagtgtattttgtttttcattataaaatggtgttttattttatttttattgaaaattaattttaatacaataaattacagttttctctttttccttctcctcccagttcctccctacgtccctttccttctttttttttttttttttttttcaataagatcctgagagtttattacatttaatttttttttccattttttattaggtatttaactcatttacatttccaatgctataccaaaagtcccccatatccacccacccccactcccctgcccacccactccccctttttggccctggtattcccctgtactggggcatataaagtttgcaagtccaatgggcctctctttccagtgatggccgactaggccatcttttgatatatatgcagctagagtcaagagctccggggtactggttagctcataatgttgttccacctatagggttgcagatccctttagctccttggctactttctctagctcctccattgggagccctatgatccatccattagctgactgtgagcatccacttctgtgtttgctgggccccggcatagtctcacaagagacagctacatctgtgtcctttcaataaaatcttgctagtgtatgcaatggtgtcagcgtttggatgctgattatggggtggatccctggctatggcagtctctacatggtccatcctttcatctcagctccaaactccgtctctgtaactccttccatgggtgttttgttcccaaatctaaggaggggcatagtgtccacacttcagtcttcattctccttgagtttcatgtgtttagcaaattatatcttatatcttgggtatcctaggtttggggctaatatccacttatcagtgaatacatattgtgtgagtttctttgtgaatgtgttacctcactcaggatgatgccctccaggtccatccatttggctaggaatttcataaattcattctttttaatagctgagtagtactccattgtgtagatgtaccacattttctgtatccattcctctgttgaggggcatctaggttctttccagcttctggctattataaataaggctgctatgaacatagtggagcatgtgtccttcttacctgttggggcatcttctggatatatgcccaggagaggtattgctggatcctccggtagtactatgtccagttttctgaggaaccgccagactgatttccagagtggttgtacaagcctgcactcccaccaacaatggaggagtgttcctctttctccacatcctcgccagcatctgctgtcacctgaatttttgatcttagccattctgactggtgtgaggtggaatctcagggttgttttgatttgcatttccctgatgattaaggatgttgaacattttttcaagtgcttctctgccattcggtattcctcaggtgagaattctttgttcagttctgagccccattttttaatggggttatttgattttctgaagtccaccttcttgagttctttatatatgttggatattagtcccctatctgatttaggataggtaaagatcctttcccaatctgttggtggtctctttgtcttattgacggtgtcttttgccttgcagaaactttggagtttcattaggtcccatttgtcgattctcgatcttacagcacaagccattgctgttctgttcaggaatttttcccctgtgcccatatcttcaaggcttttccccactttctcctctataagtttcagtgtctctggttttatgtgaagttccttgatccacttagatttgaccttagtacaaggagataagtatggatcgattcgcattcttctacacgataacaaccagttgtgccagcaccaattgttgaaaatgctgtctttcttccactggatggttttagctcccttgtcgaagatcaagtgaccataggtgtgtgggttcatttctggatcttcaattctattccattggtctacttgtctgtctctataccagtaccatgcagtttttatcacaattgctctgtagtaaagctttaggtctggcatggtgattccgccagaagttcttttatccttgagaagactttttgctatcctaggttttttgttattccagacaaatttgcaaattgctccttccaattcgttgaagaattgagttggaattttgatggggattgcattgaatctgtagattgcttttggcaagatagccatttttacaatgttgatcctgccaatccatgagcatgggagatctttccatcttctgagatcttctttaatttctttcttcagagatttgaagtttttatcatacagatctttcacctccttagttagagtcacgccaagatattttatattatttgtgactatcgagaagggtgttgtttccctaatttctttctcagcctgtttattctttgtatagagaaaggccattgacttgtttgagtttattttatatccagctacttcaccgaagctgtttatcaggtttaggagttctctggtagaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggtatgggccttgaattcctgatctttccaaaacttttatcatgaatgggtgttggatcttgtcaaatgctttttctgcatctaacgagatgatcatgtggtttttgtctttgagtttgtttatataatggattacattgatggattttcgtatattaaaccatccctgcatccctggaataaaacctacttggtcaggatggatgattgctttaatgtgttcttggattcggttagcgagaattttattgaggatttttgcatcgatattcataagagaaattggtctgaagttctctatctttgttggatctttctgtggtttaggtatcagagtaatagtggcttcataaaatgagttgggtagagtaccttctacttctattttgtgaaatagtttgtgcagaattggaattagatcttctttgaaggtctgatagaactctgcactaaacccatctggtcctgggctttttttggttgggagactattaataactgcttctatttctttaggtgatatgggactgtttagatggtcaacttgatcctgattcaactttggtacctggtatctgtccagaaatttgtccatttcgtccaggttttccagttttgttgagtatagccttttgtagaaggatctgatggtgttttggatttcttcaggatctgttgttatgtctcccttttcatttctgattttgttaattaggattttgtccctgtgccctttagtgagtctagctaagggtttatctatcttgttgattttctcaaagaaccaactcctcgtttggttaattctttgaatagttcttcttgtttccacttggttgatttcacccctgagtttgattatttcctgccgtctactcctcttgggtgaatttgcttcctttttttctagggcttttagatgtgttgtcaagctgctagtatgtgctgtctcccgtttcttcttggaggcactcagcgctatgagtttccctcttagaaatgctttcattgtgtcccataggtttgggtacgttgtggcttcattttcattaaactctaaaaagtctttaatttctttctttattccttccttgaccaaggtatcattgagaagagtgttattcagtttccacgtgaatgttggctttccattatttatgttgttattgaagatcagttttaggccatggtggtctgataggatacatgggacaatttcaatatttttgtatctattgaggcctgttttgtgaccaattatatggtcaattttggagaaggtcccgtgaggtgctgagaagaaggtatatccttttgttttaggataaaatgttctgtagatatctgtcaggtccatttgtttcataacttctgttagtttcactgtgtccctgtttagtttctgtttccacgatctgtcctttgaagaaagtggtgtgttgaagtctcccactattattgtgtgaggtgcaatgtatgttttgagctttactaaagtgtctctaatgaatgtggctgcccttgcatttggtgcgtagatattcagaattgagagttcctcttggaggattttacctttgatgagtatgaagtgtccctccttgtcttttttgataactttgggttggaagtcgattttatccgatattaaaatggctactccagcttgtttcttcagtccatttgcttggaaaattgttttccagcctttcactctgaggtagtgtctgtctttttccctgagatgggtttcctgtaagcagcagaatgttgggtcctgtttgtgtagccagtctgttagtctatgtctttttattggggaattgagtccattgatattaagagatattaaggaaaagtaattgttgctcccttttatttttgttgttagagttggcattctgttcttgtggctgtcttctttttggtttgttgaatgattactttcttggttgttctagggcgtgatttccgtccttgtattgcttcttttctgttattatcctttgaagggctggattcgtggaaagatattgtgtgaacttggttttgtcgtggaatactttggtttctccatctatggtaattgagagtttggccgggtatagtagcctgggctggcatttgtgttctcttagtgtctgtataacatctgtccaggctcttctggctttcatagtctctggtgaaaagtctggtgtaattctgataggccttcctttatatgttacttgacctttctcccttactgcttttaatattctatctttatttagtgcatttgttgttctgattattatgtgtcgggaggaatttcttttctggtccagtctatttggagttctgtatgcttcttgtatgatcatgggcatctctttttttatgtttgggaagttttcttctattattttgttgaagatattagctggccctttaagttgaaaatcttcattctcatcaattcctattatccgtaggtttggtcttctcattgtgtcctggattacctggatgttttgagttaggatccttttgcattttgtattttctttgactgttgtgtcgatgttctctatggaatcttctgcacctgagattctctcttccatttcttgtattctgttgctgatgctcgcatctatggttccagatctctttcctagggtttctatctccagcgttgcctcgctttgggttttctttattgtgtctacttccccttttagttctagtatggttttgttcatttccatcacctgtttggctgtgttttcctgcttttctttaagagcctgtaactctttagcagtgctctcctgtaaatctttaagtgacttatgaaagtccttcttgatgtcctctatcatcatcatgagaaatgtttttaaatctgggtctagattttcggttgtgttggggtgcccaggactaggtggggtgggagtgctgcgttctgatgatggtgagtggtcttgatttctgttagtaggattcttacgtttgcctttcgccatctggtaatctctgaagctagctgttttagttgtcactgttacgagcttgttcttcaggtgactctgttagcctctatgagcagacctggagggtagcactctccttagtttcagtgggcagagtattctctgcaggcaagctctcttcttgcaaggcaggtacccagatatctggtgttcgaaccagactcctggcagaagttgtgttccactcactagaggtcttaggatcacgtgtggagtcctgtgtgggcccttgcgggtgtcaggcgactcagctggcaaggtagccggggctcgagtggagtggaaggggtttgtgccccagatcaagcccgggtagcctgcttccctatgtaccgcagtctcaagttccgcgcgattggattggggcaggcactgtgatccactcaccagaggtcttagggtcccgtggggagtcccgtgtggacccttgcgggtgttgggcaagactctgctggcaaggtagcccggggctcgagtctcgagtcgagcggaagggacttgtgccccagatcccgtccctttccttctaggtctaatccctttctgtctttcattagaaaagcacatccaaatgatagcaactaaacatagcaaaatgaaatataataaaataaaccaaaaacataatgttgtgggtggagaatgcaacctgacagaaggaaaagtaccacaggagcaggcacaagcataagagacacattggttaacacattcaggaatcccacaaaaacactaaactgaatgttatagcatatatacagaggacccaatgcagtctattgtaggctcatgaacagagaggtacgaagaggtatgtcctttggcaggtatcatatttgtttgtatgtgtgtatgtgtgtataatttatgtatgtatgtatgcaatttatgtatacatataatttatatatacataaataataatatacataatgtgaatattatgtatattacaaataacaatgtaacaatgttatgtataacataatttatatatatttatataatgtaaataatactttgtctatgattttttttctcaaactatttattacataaacatgatttttcaggttttttatcctggaattttgctgaatgtgattattagcattatgcagtttctggtggcatatttagcacaattttttacttatagaatcatatcatatttaaattttaattaattgacttcggcttttcctactcctatcgcctttacatctttcactcttgttgcttacctaagactcctaatactgttctgaataagacaggaagtgtgagcttccttgtcttgttcctgattttaatgaaagtgctttgagtttctaatcatttattaggatgctagctctgagtttgattttcattgtcttattatgctgaaatatactctctttaacattatcagtgaccacatttctaaggaaactggacacttgctatcttagtagtattcattactatagaaatgtctgcaggtagggttggaatatttagagcaccttcatccttctttcttgaatttgctctagatattcttaggggaatatacatttaaccataatttttggaggtcatgtttaaacagttatatcatttatagagaaaacatttctgagtacttctccaatcctctagctttcatttagtttccacaactttttcctgaatattgtttgaccccagtacaggtagttttagatgtcccaactatggctgaataatgacagttcctcattctcagtattttaagtagttattcacctttgtgctaatcaacaccaactctaataagagtctaatctactcaaagaatcaccagcatgtaactatggaaataaacaaaaatgtttaaatggaagtttgagaaaatgaccagttagaaaaataaaattagtatgttttctgctaagacctacaaattcctttggcatgtttgatgccagcgtttgcagtatcattcatgaattctctcctgaagaacaggcattgatttctaatcaatactgaggttaattactcgagtaagtagtcttaccacagttgcactatgaatgcattgaacctggcaggtcattaatatagcatgaaaagtttaatgatggataagaaaattattaatttttactctacttagaaaatgcagagagacattttctagcactataaaagacagccagcatggaaagattcccgggtagttaaatgtgggtttctccatcaaacagtatgtatagtgtcttatataacatggtcttaccatgaagttaacatggggcaattgagaacatgcatgattgttggtatatgcttcctaggattctttgacttttttattattattaattattttagttatttactatccaaatattagaccccttcccacactcccctccacaagcacccaaccccacccccttcccatcacctctaagagagacttctcctatgcacccacccactcctgcctcacatctctcacatcacccttcaatggggcaacaatcctccacaaaaccaaaagcctcccatccaattgacaccaaataagataatcctctgctacatatgcagctggagccatggaatcacccatatttactctttggttggtggtttagtccctaaaaggtataaagcatctggttgattgacattgttgttcttcccatggggttgcaatccccttcagctcctcagtccttcctctaactcttccattggggttccccaggcccagtccaatggttgactgtgaggatctgcatctttcttagtgaggttctagaagagtgtctcagaggacagctactgctgtcaacaagcacttcttggcactagcaatagtgtcagggtttggtgtctgctgatgggacagataccagggtggggaagtcactggatggactttccttcagtctttgctccaattttttgtccatgcatttcctttagacaggaacaattctgggttaaagaatttgagatgggtggatggccctatccctcacctagggcccatgtccagctactggatatgtttttttcatgttctatctccctagtgatgggtattttggctaatgtcatccccaatggatcctaggagcctctcacaaccctggcatctgggactttctagtggtcccccctgtaccctacccctactacacatttctattcgttctcctggtcctctgaatttctttcctgtctcttctcgtaccacaagcctgattctgcctcccccctccctttcccaacctcaccaagttccctcctttcctcttcctcccatgattattttatttcactttctaaatgcaattgcagcattcacactttggctttccttcttgttaagcttcatacgatctgtgagttatatcatgggagttctgagattttgggctaatatccacttatcagtgagttcaaaccatgtatgtccttttgggtctgggttacctcactcaagatgatattttctagtttcatccatttgcttataaaatgcataaaggcattgtttttgatagctgagtagtattccactgtgtaaatgtaccatggtatttttgtgtacatttttctgttgagggatatcttggttgtttccagtttctggatattacaaataaggatgttataaacataacagtccacatgtactttttatatgttggagcatcttttgcccaatagtttcttcatgtagaactttctagtcttctgaggaactagaaatcactttggaatgtaatttccaaagtggttgtaccagtttgcaatcccaccaacactgtaggagtatccggaaacacatggtacagacttatatgtaaattattctctctctctctctctctctctctctctctctctctctctctctctctctctctctctctctcacacacacacacacacacacacacacacacacacacacacatacacagaggctacagattccataagataaatcataaacatggaagagggtctcacaaatcttaaaactttggcctcgtgaataccagaaatctcccttacctctgagactgaacaagaaataaaaactcaaggccagttatcagatacacgtatcacaaacaatctccacgaaaattgtcacaactaagaaattacaacttgtattagttagctttctcttgctttgataacacactgactgaaaaccagttcttgaggaaagtgtttatttggtttgtactttctcattacagctcatttttgaggaacatagactaggaactggaaatcaggacttaaagcagaaactacaaaaaagcactgcctactggcttgctcagattattttcccatacaattcatgaaagagctgcctagggatggtagcatagtgccctaaggtctgggtacttctgcatcaatagtcaagaaaatgatctttcgcacatgtctactgctcaatcagatggagtcattttctcaattaaggttcatctgcagagatgagttgaccttgtattaagttgaaaaactctgaaaacaaaaacaatccaaaacaaaatagagaagagaaacactaaacatcaaacctctgttccctggactccaacccttgtttctactctgagttcagacagactaaacagactgttaaacatcctgtgttgttccaattttgcatttgacactgcttcaccttgcatcaaatttatgcctgcctttcactttacacaaaatttttatctggtcccctgtgggacttttacttacatctctaacacctttttgcttggagtgatgcccttccgaactctccagtccctttaaaaccttcttatccactttgtaatctctctctttctctcactcatattcataaataatactgtgtgcagtgtagtgtataatctaagggttctgaataaaattgtctataatttccaatggatacactactatatgaaattcagattacttatacaaatatgaccaccctccgttttattgatgcagaatattcattacaatatcaatttcttatgactctaaaatgattaaatttaaaatgaaattatttttcctgattttagatactgggaaacacaaaaaggataatgccttctgcacactcatggaagattggaggatattgatctctagccacatagtgaaatccagttatcacactggcccatagttttcaatgaaggcgctaggaaatatgaaactcccaaataccaacacattttctgcaactcagctcactaggagatttagcaggaataaagttctaccctatttacacttattaaagtttttatttcttttttttcttttcctttgtttattaggtattcatttcatttacatttccaatgctatcccaaaagtcccccacaccctcccccacccactcccccacccacccactcccacttcttggccctggcgttcacctgtactgaggcatataaattttgcacaagaaatgggactctatttccactgatgaactactaggccatcttctgaaacatatgcagctagagacaggagctctggggggtgggggtgtactggttagtgcatattgttgttccatctattgggttgcagataaccccagctccttggtgctttctctagctcctccactgggggccctgtgatccatccaatagctgactgtgaacatccatttctgtgtttgttaggcctcagcatagtctcacaagagacagctatatcagggtcctttcagcaaaatcttgctagtgtatgcaatggtgtcgtcctttggaggctaattatgggatggatctctggatatggcagtctctagatggtccatccttttgtctcagctccaaactttgtctctgtaactccttccatgggtgattgtttccaattctaagaaggggcaaagtgtccacactttggtctttgttcttcttcagtttcatgtgttttgcagatagtatcttgtatcttgggtattttaagcttctgggctactatccacttattagtgagtacatatcatgtgagttcttttgtgattggttacctcaattaggataatgtcctccaggtccaaccatttgcctaggaatttcataaattcattcttttttatagctgagtagtactccattgtgtacatgtaccacattttttgtatccattcctctgttgaggggcatctgggttctttccagcttctggctattataaataaggctactatgaacatagtagagcatgtgtccttcttaccggttggggcatcttctggatatatgcccaggagaggaattgtgggatcctccggtagtactctgtcaaattttctgaggaactgccagactattttcagagtggttgtacaagcttgcaatcccaacaacaatggaggagtgttcctctttctccacatcctcgccagcatctgctgtcacctgaatttttgatcttagccattctgactggtgtgaggtggaatctcagggttgttttgatttacatttccctgatgattaaggatgctgaacattttttcaagtgcttctcagccattcagtattcctcaggttagaattctttgtttagttctgagccccatttttaatggggttatttgattttctggagaccaccttcttgagttctttatatatattggatattagttccctatctgatttaggataggtaaagatcctttcccaatctgttggtggcctttttgtcttattgacggtgttttttgccttacagaagttttgcaatttcatgaggtcccatttgtcgattctcaatcttatagcacaagtcattgctgttctatttaggaatttttcccccgtgtccatatcttcaagaattttccccactttctcctctataagtttcagtgtctctggttttatgtggagttttaagaaataaaaatagcctgtgatattttcataaaacctgggtatttataaaatagtgggtttttaaaaaatattttttattattatgtatttttctcaattacatttagaatgctatcccaaaagtcccccataccctccctcccactttcctacccacccattcccattttttggccctggctttccctgtactggggcatataaagtttgtgtgtccaatgggcctctctttccagtgatggccgactaggccatcttttgatacatatgcaactagagtcaagagctccggggtactgattagttcataatgttgttgcacctacagggttgcagatatctttagctccttggatacgttctctagctcctccattgggggtcctgtgctccatcaaatagctgactgtgaccatccacatatgtgtttgctaggccccagcctagtctcacaagagacagctatatcagggtcctttcagccaacgcttgctagtgtatgcaatggtgtcatcatttggaggctaattatgggatggatccctggatatggcagtctctagatggtccatccttttgtctcagctccaaactttgtctctccagaaaatcaaataaccccattaaaaaatggggctcagagctaaacaaagaattcttacctgaggaatactgaatggctgagaagcacctgaaaaaatgctcagcatccttaatcatcagagaaatgcaaatcaaaacaaccctgagattccatctcacaccagtcagaatggctaagatcaaaaattctggtgacagcagatgctggcgaggatgtggagaaagaggaacactcctccattgttgttgggattgcaagcttgtacaaccactctggaaatcagtctggcagttcctcagaaaattggacatagtactaccggaggatcccgcaattcctctcctgggcatatatccagaagatgccccaaccagtaagaaggacacatgctccactatgtttatagcagccttatttataatagccagaagctggaaagaactcagatgcccctcaacaaaggaatggatacagaaaatgtggtacatttacacaatggagtactactcagctataaaaaagaatgaatttatgaaattcctaggcaaatggttggacctggagggcatcatcctgagtgaagtaacacaatcacgaaagaactcaaatgatatgtactgactcataagtggatattagcccagaaacttagtatacccgagataagatacaatttgcaaaacacatgaaactgaagaagaacaaagaccaaagtgtggacactttgccccttcttagaaataatgggtttttaatggaaaaaaagcaaatacagcagacaaggggatatacttaaggaaaacaattttggcatactcatttgcaattccaagagtatctgacctaagtcttcagagttgttcagatcacaacctaagaaattaaaaatcatttaaagtgaaattttattttgttgatatcctctttatttaccattctattcagcttagtttcatgaactctaaagcatggttagaagttcttggtaagaatctgtagtcaaacctgtgcaaatatagtgattttccatccatacacaacagttgcatgtgtaattgaagcactgtggtgactcactagcacagccttgttgcagggagcatggtgactcaagtcaattgtagcaggtcctgctcagaagagagacagccaaaggagtgagtttcatccatttgaagaatggtggacaaagaaatgcagaaatcaagcacagttaccaaagccaccactgtgtcttccatagctggacactcattttacatgttaaggattgcagatgttaggaattggaaccttgttgtataaatgtaaaatctttggatctaaagaatcaaatcagaaagatatcagataaggacctggactcagttgcccctccctccatcacatcggcttcacggtgcttctacttttggtctatcaatgtgtcctgtcactttagcatagttctctttctggtttgacttgtagtttttatgacaattgctttgtattacaagtggaggtcagaaatggtgattctgccggaaggtattttattattttactattttgactatcatggattaattattttttcatataaagttgagaatatttgcaagagaaatttatatatattttaatgtaccagttcattttacagacacacccatcccagcacgtatttcttatatactaatatgtataaaataaatgtgtaaaatcccagttacatttcctggctttattattatagttaaatttattaactttgccatattactatgatattatatgtccctcctgttcaaaatctcctgtcttatgtcaatggttcaaatttattttttatgtactcttctctcatattcagagcatcaggtcttatgttatagtccttgatctacttgcagttgagttttggcatgtaatcaataaagatctaatttcattcttttatctgtaactatccagatagatcagaaccatttagaggaaaacatttaaattttgtccaacaaacatgtgactgtatcagtactggattatatgtgtcatcatttcttttcaattgatcaatgtaacaaattttaattcatattgtgtagattttgttaattttactgtgtaggaccatgttaaatctgggatcttggtaattccttctgttcttttatgcagggtttttatttttgtttttgttttgctttggtgattttttttgttttgttttgttgaagtttttgtttgtttgtttgttgttttttgtttttgtttttgccaaagtgaaatttcttgttcccatatgaaattacaattatacttttaattttgtatgaagaattttgcaggaggttatagttaatgtatgaattgtttttggaagaatagccatttgcacagtaataggtctgtcatttcatagagagagagggatttttaccctgtaatttcttcaattaacttttctagtttcttaaattgtcagtatagccttttataatttgtttgtgtgaatgtgtgtgtgtttgtatttgtgtgtctctgtgtgtgtgtatatgtgtgagggtgttgtgaatggcattgtttctatggttttttattagtatctttgttctatatgaaacctattgaattgtttattaaattattatcctgtcaccttttctaagtgtatcactaaaaataggcttctggttgaaaattaaggacatttgatatatagaaacacataaatacaaacgaatacagtttaacctctgacgttactatctatagcatattttttctcctttgttctttttcttgcactaagacctctaataatgtaataagtaggagttgaagagtgaacatccttctcttgttccaaagtactatcataaatatcatttacaactattctggctcttaccttgttatatgttgtctctcttaagacaaaatatgttctctgtatccttaccagtggccacatttctaaagaaaagtgacacttgctcactaggagccatcaatgctgatgttcccaggtatatgcccaaacaatacatgagtactcatttactgtactgtattttgcatggctttttaatttatgttttcatcaacactgaatgcaacaagaatcatgactaaccaaaccctgagaacagcacaaatttctggatataatcagaaatatcttttttgtgtgaaaatgacaaattataatagcgtcaaataattttatgctagaacctacatcttcccacatcatgtatttaactatgtttgcagtgccatacctgatttttcaccctgtgaagaaagtctcaattgcaataaagaaagtggttggatagtcctataaacagtcttaccactactacaccactggttcattttggtttccatgtcattatagtagcctacaatatacagcaatagataaaaatcattatcttatcagactgaactcagggaacgtggtgggggatctggcagaggactggaggaccaggggggagttgcatctccatggaaagaacgacataagctagtctgtttctcttagagattagaccaaccaaggagtgtacctatagcaaaccatggctccagatatatatgtagcagaggatggcctaaactgacagcaatgggagaggagactcttggtcccggagaggtttgatgacacagagtagggggattctggatttggtgagacagtgtgggtgggtggggaagcactctcatataggcaaaatggagggggagagcatatgagggatggagggtggtagaggggtaaccaggaagtggaatatcatgggatgggtgatttgtggagggagttaccaggaagtgggatatcatttgatatcattttagttgtaaacaaatagaattatatatatatatatatatatatatatatatatatatatatatatatacacacacacacacatatatatatatatattcctttctcttgctaacaaactgaatagagctttctagtactatgaaagatagctaacagaaacaattttctggctagctcaagcttgatttttatgtctggcaaatgaaatatgtaataccttcaacaatgtggtcttgtcacatttttaaggagaataaaaaataatcatgtgttattttagatgctttattggtttctctgaccaataactattacagaattaatctctgtctttcaataacatttgtatttaataacccatgtattcttgatcttcattctcttattaattacataaggtttaaggctttgtgtccagaaaatatcctcaacaatttagtaatcttgatttcttacaggtctaacacttttaatacagatttgtcactggtaatattgaatatgtgagtaaaagaaatatctccttttgttagaaaattcttttaaagcatgaatttttcaaacaaaaagaagtagatggaatttacaatgttaaatcttatgtgtaatcccttcttgggtgagatgaactgtgagtaccattgtttgagtactctttggataacactagttgtgagaaatcctagactgtagttttcgactcagtttccaaaagcaccaaaagaactgatattaaatatggggagaattagataaagaatcaaaatgttatttatctgactcaccagtaaggaaaaaactattgcaagcaattcctattacaggcttgaacaattggacagtacaaatgaaatcagatgcttattagtgtttttgaaacagttgagatatgcaggtgtagatcatagtagaaattatgcccactgggatacatttcctgagttgaaaccccagtgtttcaataaaaaataaatttcaggcacctgtgagtgggtagagaggtagaagtgaactccagtcaaccaaatgacagttccatacaggaaagcatcatggcaaaagtagagaactgacttccacatattttactctgaccaataaatgtacatcctcccaagagtagattaatttaattttaaagtcttaagaagaatgaacatgccaggcagtggtggcacatgcctttaatcccaggacttggggggggggagggcggcagaggcaggcagatttctgagtttgaggccagcctggtctatatagtgatttccaggacagccagggatatacagagaaaccctgtctcaaaaatcgaagaagaagaagaaggaggaggaggaggaggaggaggaggaggaggaggaggaggaggaggaggaggaggaggggaggaggaagaggaggaggagaagaaggaggaggagaagaaggaggagaaggaggagaagaagaaaagaatgaacatggaatatatatttgtttttaattgctaattttttaaaatagaatttttcaggcaatatattataattgtgtgccacgtcattttctcctacctgatttttgctacctccataaccacctaaaccttcttgttctctctctcacacacattagaaaacatagaggcaattaaaaaaaaaactaacagaaataaaatggaactaacacccaacggaatcagaaagaaaactcacaagaagcatatacatacataaagacatatgcccaaacataaagacaaattaaaacaaaaaattcaaagtcataatatatgaaaaaaatcaccagtctggttaaaatacagtacaaaatgagtcaaaaatcataacccaaaattattgttgattcacatgtgttatctatctactgcctggaattggattctgcttcttcatgtggattctatacccagtaaggtactactggggtgtactagtttttccattttgagaatgtgtcaaatagagatacttcctggtgaagcgtggaagatcatatattatttttgctctcagtgcatgggcccttaaataactttgacctgtacaaaccttgtgcatgtgtcattctttgtagtacttcacatgtgcatcagtcctattatttctggaaggtattgttgccttcctggcatccctcccaccactggcctttgtagcattctacaatgtcttctgaaaattttgctgagccatgaagaaggaattcagatggaaatatgtgatttatgataggatgattcaatgtttttactctacacattgtacagatatggttctctgtatctggccccatttactgtatatgttagcttcttcaatgaaggtgcaacaatacattgaactatgagtataacagaatgtaatttaaaatacttttatagatacacatcataccttactgtggaaggtcaaatagtatagaactgggttggtgtttaaatttctactcaggtgccatgcagaataatttttagtaccacaaacactattcagtaggtgaaggttttagctaggcacctacttgtcttctctatgtgtaatagaaatgtaagcattatcatctgcaataaagacatcattggtttgtatagaaccatcaacaacttggacaaaaatctaagttggggaagggaaactgggtttctcaagatgaatatttctctgctttatttaactctgagttctactattttcttaagagctgcgtaatattccattgcataatgtaccacatattcagttaccatttccccacttatgaaaatctaggttgtctcctctttctttctaatatgaatatacttggaatgaataggtgtctatatagtaggctatagactcattttttggatatatgcccaaaaatgatacacctgcatcttgaagaatgacatacttaggtatacaaggcaaatcacactgatttccaaagggctgaactactgtttttttggaccagtagtggataaggattcttattattcatcatcctctctagcatgtgcagtcatttgttttattgatctggggcatactgattagttgaagattaaatctcagtgttgtttgaagatgcctattcctgattactaaaaatgttaaacttttcttttagtgaaacaaatattttcatggtcaattatgggtcattagattaaaaccacatgacaagtggtgcttgaagcagtgttgcctctatgctcacagtgacatgtagcttttgaccaaacaggaaagttgatggaaacctctaaaaaagagttcttaggattttctaaggatataaacattcatatcaaagcataatcctatccataatttctacaggggacatctaaggtatgttctccttcaaaaacataggaagcataatgcaggaccctgtgagctggcgcattgcattatacacaaattagcacagtagctaaagataaatgagaatccagtaataattctctgactgacttaaaaaaatgaatgggatttttgagcagggggaggatgatggaatagggagttttcagatgggaaaccaggaaagtgcataacatctgaaatgtaagtaaagaaaatatccaataaaaaaagggtggaaagaaatatttgcatgggcacatacaatgtgcagatttaaatgacaaatttaaatctattagatttaaatttattagacaattgggtctattttatttttttatacttcattttgtttaggtgcacattctaccacatattttcatttcagttacactataaatcatgtaacaaagaggactttatctgttaaagtgttgtaacaacaacaaagatgctactgcagtgtcctgctccagttcatagactggctacaggaagtaaatcataaaagtgctgcgtggaatgatgccctgccccacaggcccctgacctctggcaagacaaaatatggtgaaactacaaagaccaaagttttcttgcgttttcaacttcttttggtgccaagcttagaagtgacacctgccttcattaaagttttgtggtagcaggaatggtttgttttcaccaggttcctgttcaggacttgttgattaaatcatgaatttgcaattattgctgatagtacaatcctgcattttttccttaatcatgttttcttcagatatagatttacacatgcgccaaaaaattgctgttgtaaaataagatattgacaagttcaatattaattcggggactacagaagtcaagagtgaccgcacagtttatttggtttgttgttgttgttgttgttgtttgtttttgttttgttttgttttttgtttgtttgttttttgagacagggtttctctgtgtagtcctagctgtcctgatactcactctgtagaccaggctggccttgaattcagaaattcgcctgtacagttttaaaatgaaaaaaaattcataggattttgagcagattcataggctgttgtggatttttttaaacataatttatatgtgattctttaaatggaatgtggatgtctaacactggacatgctttgtattatgcagttctttaatatatctgccaatatatatatattgcacagaagtgcaagacaaagttttataggaaatacatgcttcagtgccacataatttgccatcaagtattatgccaattacaggatatggggagtggtggtctcagttactttaattaattttgtgggttttttcatttaatactcatttctctttttagactgtcagcaaagctctttgttatgatatcaaaagaaacttcaacatacaatcttcttgtgaagacatatcagaatgcatcataagatcttggcaattcatttatagtcaaaaagcaagtgaaggaccagtggatagaaaatgactaagtactggggaagactgtctcaataaggataagacattatatgctggtaacaatatggagaaagaggaatactcctacattgttgatgggattggaagctggtataacctctctggaaatcagtctggcacttcctcaggaaattggacaaagcactaccctcaggtatccagctatttaactactgggcaaaaaaaaaaaaataccccaaaaatgttccaacatataacaaggacacatgctccactatgtccatagcagccttatttacaatagccagaagctggaaattaccagatgtccttcagcagaggaatggatacagaaaatatggtataaaatattcatgggcggtagagggtgggagggacttgggaggaggaaagaagagagaaaaaggaggcaggatcaggcatgagaggagttgggggtgatatccagaggctcaggaatttaaacagaggtgtgtagaaatgagagatgggggactgagggtagccaccagcaagtcccagatgaaaggaaagcaagaggcttccaggacccaacggggatgaaagtagctgaaagctaatatctgataaatctaccacttggattacagatttgtcaatagtaatattaaatacatgagttacaaaacattttcgttttattggaaaagtgtttatttcaccttaaaattttcaaatcacacaccatccctgagtgaagaaaaggtggagacagggactttagcagaagccatactgatgatttccaatttgcttcctgtggcttgctcagaatgattccttatacatagcaggattactgaccacatgtggtaccacacaaagtgggctgggtcctcacacatcaatcatcaattaagaaaatgactcacagacttgtgtacaggcaaacagaaagacacagttcaactgaaattctctattttcagataactcagcttgacataggtaacaaaaaataaccagaaaaaatgtgcacataaatgtacataacacatattttatatattacagaatttatctacataagtgagatacatttttgatcagtgaaccagaattcaaagtccagaaacaaggcaaaattgaatgagcagttgatttttcacacaaaacccccgaaaacctaatggttctcaagtggctttttctttatatgtactaacactcatttatttggaaatcttttaagataaataaacttacttttaatgcactttaaaatcactgaaaggaagataataaaatatataaattacttcaactgaaggacatttgtttataacttttccattgatttcatatatatatatattacagttattaactctatgtgtgtatgtatgacttgtatgtaagtgtaggtatatacatgaaacagtatacctgtaatgatcagaagataatctttgtgagctagttcagtttcctccatgtagattccaggtatctaatttatgtctctaagcttgcatggcaggatgccaagatatttcattggcccgtttccattaacaatattgaattaaataattaaatgcacataaggcaagtaccacatcatcctagtagtatatgtgcatttttatggttgcttttgaggacaatttccaataagaagtattgggggttaatttctcaaaactttgtgaggcatgttcaatttatttacttcaaattatcaataaattctaatttattttttgaaaataattttactggtcattttattaaatatgttttactttcaatgaccctgctgctacacacagacacaaatactacaaatgtaccagtaaatattctacctgtttttattttaataacattaagaaaaacttcttacaatgttgtaacagggtatagtattgtgacttgtaacatagcaagtattttgaaatagcctgcagtacttacatggaagaaaagcatgagttatgttgccaaattcctgatagtggaaagaagttgccctctcaatgggggcttattctgtcacaagggactgagtctgtttggaaaagtctgtttcctcatatactgtgtggaagttactgaaaaacatttgtatttaagacatttcttttcatttccatcagaaattatctagctttcattactaattggagtttaaaaatggtgtgttttgacttactggagtgcttgttattggaaaacctagtggccctcatttatccatctctgggttctatgggatggcatgattatatgttctccttcaattcacttcttttttccattaatttatttattcattttgcatcccaatcactgatacctctccttgtattctgttcacagggtacttttctgttaatcttctttctcttatattctgagagggtggaggacacactgggtattgcctgaccatgatgcctcaagtctattaaaaagtatgtgcatcctctcccactgagggagaaaaagaatctcagcacaaggaattgactccacaaagaggcaaaagagttagggtcagcccctgctccagtttttctaggacccacatgaataatgagctccacatctgctacatatgtatagaggtcctaagtttaacccctgtttggttggtggtttggactctaagagacctaagtatccaggttagctgattctgtgcatttttctatagatttactatccacttcttggccatcaacccttccataagattcccacagctccaatcaatatttggctgtgggtctctgaatctgcttctgtctcatgctgaatgtctcctctcagagggagtcatcctgggattctgtctgcaagcacagcagaatacctttgagagtttcaggcattggtgcctgaccatggggtatgtctcaagttggttgggttattgtttggccattccctggatatctgctccttctttgtcactgcatttcttgtagataggacatatttttggtcaaaagttttgtgtatggtttggtctccttgtccctccacttacattcatgcctggaaacttgaattatccctttcaggctttgtatcccacaagagaggaatttaaattgtaacacatccttatcttatctcttctgtaatttaactatctactgacctgggcttgcttctgtcctgggggtgcccaggcttccttgttcaccattctggaatggaaagaatgaagcttagctggaccaggttgtttaaagaggaatgtggtctgcatgagtgttagataaatggccttcttcagagatggctttcacctaaactgcttttatttattgggtaaaaagagttatataaactgcagagaagataggagattggggatgagtatgcattattagctgtggctgaagtgctaggaaggtttcctttgcctaaagaagaattctagatgcttactagagctatcctcatagtgagagaggaagtttaaacagtaatttagctaccagactactttactacttcaatagtaatggaggttgtgtcataaaacctatgttctttgggacaaactggcccagaacaacttggaaaatagccctacttctgctgattttcagtgacctcattctttctccagactgtctccacagggcattccattctgggcctgaaaactatcctctaacatttacatactgaaactgacgaagaaaaaataatgggtcaaataaagttgttggttacagttggctgaagagatggatcagcagttaagagcaccaactgctcttccaaaagtccagagttcaaatttcagcaatcacatggtggctcaaagccatctgtaatgggatttgatgacctcctctcatgtgtctgaagaaagttacagtacacccatataaataaaataaatacaacttaaaaataaaagtgctatttacaagtaacaaaaagtattgttacttaagaccaaattttttattaatttggaaaagagataaactacccaaaagagaaatactaaatctaggacaagaataaattctaaaatgtctaaattataaagaactgtatatacaacggaactaacatagtcaatgttgataagatatgtgatgggtgggatatacagagggtcagaaaattgaatatatgtttgtagcaatgggggatggagaactcaggtagccaacagaaactccccgatgccaggaaaacagaggttcccaggacccaacagggatggcattaacttaaataccaaactaaaaggagggagagcctgtggagaccatatccagaggttaggcaatgccccaagttgcaggatatgaccacccactcatctccaaacatttaatccagaatttctcctgtctcaaggaaatacagggacaaagtgtggagtagagactgaaggaacagccatccagaaactgccccacctggggatccatcccatatgcagacacaaaatccagacactgttgctgatgccaagaagggtttgctggcaggaccctgaaaaagaccctggttgctgtctcgtgattgactctgccagaaactgacaaatatagttgcaaatgctcacagccaaccaacctactgagcatagggatcctaatggaggagtttggggaagtactgaagcagctgaaggggtttgcaaccccaaaggaagaacaacaataccaaccaatcagacatcccagagctcccaggaactaaatcagcaaccaaagagggcacatggagagacccatggctccagctgcatatgtagcagaggatggacttatctggcattaatgagaggggaggcccttgatcctgtggaggctcaatgccccagtgtagggtaatgctagggtagtaaattgggagtatgagcataggtgaaagaggccctcatagaagcaggggaagggggtaagggataggagttttccagaggagaaactggtaaatgggataacattttaaatgtaaataaataaagtatccaatctaaaacgaaaaatagtaaatttaaaagtaggataagggctggtgagatggctcagtgggtaagagcacccgactgctcttccgaaggtccagagttcaaatcccagcaaccacatggtggctcacaaccacctgtaacgagatctgacgccctcttctggtgtgtgtgaagacagtacttacatgtaataaataaatcttaaaaaaaaaaaaagtaggataaatgattttgaatgccctgcacttccaatatctcaaaaaatataaagaaccatatatgcaatgcaaataacatagtcattgttaataagatatgcgatggtgcaagcagaggaatctgtgggtagataggttgtttgcttctctaaattgctattgttacttctgttatttatactatggtctttaatgttttaccttcatgtacagcaatcctattttatcattgcatataaatataatgtcatatacagcagaagagtctaataatcacacctggatcaggaaaataattaatactggtatgatcctggattttcctacttaatgcttttaccaactctttgtataccctgaattttgccacatattttcagcatttaagaaagatttcctagaatcatgtgaaatataacattagattgttgaatgtacagaatgtgatttttagacaacaagggagacactcaactaaagcttacagaaaaaagaaaaatgatatcacctaaatgtttgagaaatttgaatgattcataagaatattgcaattttgaatatttggaatgttaaagatctaaaatcaaaatatcttgggtgtttttgtacctatattagcaacttatcacccaacctcccctcatttaacatactttcaattagctggcaaaacttttgaaatttattattagatcactagctaaagaacagaaacatgaaacctacaatagatttatcatcaagtgtcatattaaacttaaagtaggtattttctcattttccataccccttcaggagattttcctcataaaatacctataaaatacattaatatatgaattttttttacaatgtggctatgcaaatctttgtaaatactttaatgttgcaacatatgttgaagtcatcctaaatctctgttctacgtgctgacatccatacttgactaagagaaagtaacctattattttccttttcaagtaaaatttggggatccatcaaaaatgtgtgtccacatatgtataaagttgaatatcttcatattctattaagcctaaactcttattatgatactgaaaaaatttatcactttaccctttccaattttcctgtatttacctttccagtataatagggagaatatttctatactttattttataattgaatatcaaaacagatttaaatttcatttaaaatattaagtcaatttcaatatggcaaataccatcagtaactaagataaaaattataatgtgcaaacaatgtattcgtttgaattagatttccatgttttctttaaaatttccttcttttcctctcacttttctttaagtaaagtgtcatcataattttttataaattttattttcttctatattatttaacattacatcacaaatctaccagggaaatttttttgttcgtttgttttgatcctgtgttaggaatgattacttgtggttttggatctgtttgtttgcttgttttattagttattatgtagtcaaaactgctgaacacctgaattctgtctgacttagtggaacatatgttagcatcactggaatggagaaaatccccacacatttatactcatagtggaaacgtaaaacatgatcattaaaaggatttggggaaatgttcttaatgttagagatttttattaaaaatttattttccacagtaatacaccctgattagagttgttctcccttgactagtcccagtctctgcccacatgcatttctattattacaaaacttttctaagaactacaaaataaaataaaatggtaataagaaatagtactaacataaagcaaatgctaacacaatggaaatagacaaaaggaacaagcagaaggaaaagagtccaagggaaaagcacaagaaaaagagacacagaaactcacgtatttcaggattctatactaatgttaaaatggaagacataatataggcagtggaccaagtgcaaacactcttgagagttcttatgagctcagtttatattgtttaacaaagccttgttttcttggtgctccccatgtgttctggatatgactcttgatttgcttcctctttttcatggttaacttaacagtgaaaggatggatttggtggagtcaataaggtttaggatgagtgtcccaagaatgctcactctctgaataagatgcaatgtgggtcgttgtacttattcccaactcatgaagcagtcatgaagttaaattgcatattagttggttaatttttccattgcagtagcatatctttcatgcaggatgctattgtaaattaaaggatttgtggcctgcttattgtgtatattcctatttcagtagtgtgtagactacttcattaaccaaacatagtagaacaaggttggaatgtgaggtatgggctctaagttggtatcagctgaacatctcagttttccatgaattttgtatgtgcaagccactcttcttactggaaagggcatttggtaacagacacgtccagttgtacctctgactttcatgttatgaagtaattccagttaatttgcattcatgtatgtatatattcatgaaggcttcagcgtttgtttacaaaataatcctcaaagggcccttaattctaaatgtctatccccatattccctcctctactcacttttctacttcactccttgttattctccctcaagtccccattctgccaatccctatcaaaatatttattttcccactcctaaggagacctatctgtcactcctagtgccttactctaaacttgggttgcagtttgtttaacactgatgaaacaactattgttcacatataagcaaatacatataatttttaacttttgacatctaggtttcatcattcagtgtgatgattcctagttcagttcatttacctgtgaatctcattatttattttttttaaagaatggattttttaaacaagaaaatgtacatggaacttatcaggttaaaacctacctgtaatcccatcctgggcaagataaacttcaagtaactattgtgtgaaaccacttggattgcaatagtcatgaggaaccctaggctacagttttggactctatcaaaaaaacaacaaaagaactgatagcaaatcaggagagaattttacaaaaaaaaattatctgagacatcagttaggcaaaagctgttgcaatcacttcatattacaggcctgaacaaaagaacagttcaaatgaaatcagataattgttagtattgtcaaatccattgagaaatcaacataaaatggatgcctagtgtgttacagttcctgagttgaaaccccagaatttcaatgaaaaaataaatttgaggcaacagtgagtgggtagagaaggtgaaatgaactctagtcaaatcaaatacccaaagtttcataccggaaaacatcattgcaaaagtagagaactgacttccacatgttttcctctcaccaaaaacgtacatccttccaaaaatagattcatttaattttaatgtcttaagatgaataaatgtggaatctatatttgttttaattactattttttaaaaatagaacgtttcagacaatatgttctaattgtgtgccactccactttctcctacctgattcttgtcgcctccataaccacataaatcttatgttctctttcttacattagaaaaaatataggcaaataaaaaataatcaaagcaaaataaaactaacagaagtttcaatatcagagcaaccaaagtggctcactgggtaatgaatgctggctatcttgctctaaacagtcagttgttataaagaagatgccaatataatagaggtgaatgaagtatctgggaagtgattcctcaggcacagcatgcagaaacaaactgtttcaaaaaggacaaagtcataagtctgttacctactgaactcactagtgactagaatcaaccaagtggcactgattatgaagggatcaatacatctggcttgtcactgtgtggcagggatggatttcctaaagacataccagaaggggctacaggtgaaagtacaggccagctgttgcaaggtaccacagttttttgaggatgcaagtatcataggataaccagcaagattagcagaaaccatggggtggagacagcaataaactagaagacgagctatacatgcactccagagggcaaagctagaaaagttactcaaaggttataaaagatattagaaagcagtaagtggatcacagatattaagatattgagttattaacacccttgacgtttgattttgatgtgttcacattcttgcttggttattcactcttaaagtaagaaagtacttgtactggctagttttgtttcaacttgacacagctggagtcaccacagagaaagtagcttcagttgagaaaatgtctccatgagatccaactgtaaggcatcttctcaattagtgatcaagggggaaaggccccttgtgggtggtgccatctctgagctggtagtcttggttctataagagagcaggctgagcaagccaggagaggcaagctagtaaagaacatctctccatggcctctgcatcagctcctgcttcctgacctgcttgagttccagtcctgacttcctttggtgatgaacagcagtatggaagtgtaagccaaacaaaccctttcctccccaatttgcttcttggtcatgatgtttgtgcaggaatagaaaccctaagacagtactcttaaattatttttattttataagagaacatatttcaaagggatattttcaagttttatagagaatttggatttttaaaaacattgcatgttttttaaagactgaattttgaaagtgattgataaagcaacactgagaggctttgtaagtctcaggacagatacgtttgatacttaccctttggaaatgtacttgtctaatataaagaaagttgaatttgatctttattccaattgcaagttagactgtacacacatgggactagagcatcaaggaggtagagacagaaagttatgtagctcaaggtcatcctaagcatttctcacgacagcctgagtccatttcagagaaaagataatatcccctctgtgccattttatggtggaaatatgtaactttgttttacaatggtaacattgaaagtattgacttgagactcagaagatacttttaactattaaacaatattcattctatgaaagatgatggggtctcttaaagttgtataataaatattcttattatttttattagttattttctttatttaagtttccaatggtatcccaaaagtccccccataccctccccctcactcccctcccacttcccacttcttggccctggcgttcccctgtactgaggcatataaagtttgcaagaccaatgggtctctttttccaatgatgactgactaggccatcttctgatacatatgcagctagaaacaggagctctgggggcaggggttactggttagtttatattgttgttccacctatagggttgcagacccctttagctcctttggttctttatctagctcctccattgggggccctgtgatccatccaatagctgactgtgagcatctacttctgtgtttgctagacctcggcataatctcacaagagacagctatatctgggtcctttcagcaaaatcttgctagtgtttgcagtggtgtcagcatttggaggctgattatgggatggatccccgggtatggcagtctctagatggtccatcctttcatctcagctccaaactttgtctctataactccttctatgggtgttctattcccagttctaagaaggggcaaagtgtctacattttggtcttcgttcttcatgagtttcatgtgttttgcagattatatcttgtatcttgggtattctaagtttctgggctactatccacttatcagtgagtacatatcatgtgagttattttgtaattaggttatctcactcaggatgatgccctccaggtccatctgtttgcctaagaatttcatgaattcatttcttttaatagctgagtagtactccattgtgtaaatgtaccacattttctgtatccattcctctgttgagggacatctgggttctctccagcttctggctattataagtaaggcatttttattattatatgattgtaaaactgtgagagacaaagtgtagaacaccgtggtatgaatgagatgcccactattggtctcccatttacaaatacttgattcctacttgatgtcagtttgaggaagattaggaaatgcagcattgctggacaaagtatctccctgaggatagttttctatctttcaaaactcttttgatatgtcaaacaactctctcagctttctctgtgttctgagacataagttgctacttcagcaaacttctgcttgccactcaagacacagaaagactgaaaataaccattttaatgttattaatatatatttgttgttaataaaggattcccaaatatactcctgtctatagttaaattcaatgcagactctctgcctatgtccctaaggtattagattcaaaggcatgtgccaacatgagtgcacatttttaaaaaaaaatatttaattgtaaaagtaattaatgttcaaattaaatgcacattttaaaatgaaatagaaagcattcatggtatattgactcacatatttaatcatatcattcaagagatggaagcaaaagaattactacaagtttgagtcttgtctagactatgtaatgagacactatttctcaattttaaaaaactgaaaaaaggtaagaacaaaaaatgtcaagtaaagtagaagaagaaggaggaagaggagaagttgtaggaggaggaaaatgatgaggaggaggaggagaaaaatgatgatgatgatgatgaggagaagcagcaggaggaggagaagaagaagagggatcccatgatcaaagtgaaaaaaaaatctcaagaaagtttaaaaaaatgattagcacaggtaaactggaattctatgctatggaaaggagggggtttgggaacactggacacacacaaattagtcttctgggaagaaaaatgacaaaagcattgagtacacaattctttatattcccctatagtgtaccctgtatccttttggttaattttaagatctattactttcattctaatacaactcttctaactgcctatgttaagtatccattgaatggggctcaataagtcctcttcattatacagttatggtaagcagtacacagaacttttaataagtttccgagataacactgtcaatgttagaattagaatcaaatcacaaattatgaaggcacaattttaatatgtagaatatcatagtatagattacttcacacatctcaaacaggtttttattcttagatactattgagattattctttctttcagcttgctgtgatttagaatcacattagaggcaagcctctgtcttccttgagtaggattaacttaattaatttaactgaggtaggagatcctgtccttttgtataggacaaggttgaaggagtttgtcattggtctcttcactaacaaattggctttctgggtccaggcaagaaatctacaaacctaagtccatagattgataattaggcatatgtatccacaattactcattacttttatgactaaaaaacataatttattttacaacacaggaatttctttgggtattctcagtgctctcagcccacattgacaaacagtatatggagagattattaaaaatactggattaatgttcctgtgtaggtgaccctacataatccttgattttcgtatctattgtataaagtctggaagacaggatggccatgatataaaaccctttaaccttgacatgctaggtggcagataaagatgaaatactgtatgtttaaggccagtcttttctatacggtgccgttctggacagagtgctattcatgcaaatgggttctttaaaaataatgtcagtttgtcttactgaatattttctgcctggcatcctctgacaattttcacaaatacaacactatagcattgtagtttcagtgtattttttcccctatagtgctgtaagatcaagaatcgataaatgggacctcataaaattgcaaagcttctgcaaagcaaaagacaccgtcaataagacaaaaaggccaccaacagattgggaaaggatctttacctatcccaaattggataggggactaatatccaatatatataaagaacacaagaaggtggactccagaaaatcaaataaccccattaaaaaatggggctcagagctgaacaaagaattctcagctaaggaataccaaatggcagagaagaacctgaaaaaatgttcaacatccttaatcatcagggaaatgcaaatcaaaacaacactgaggttccacttcagtccagtcacaatggctaagaacaaaaactcaggtgacagcagatgctggcgaggatgtggagaaaggggaacactcctccattgttggtgggattgcaagcttgtacaaccactctggaaatcagtttggcgattcctcagaaaattggacatagtactacatgaggatcccacaatacctctcctgggcatatccagaagatgtcccaaccggtaagaagaacacatgctccactatgttcatagcagccttatttataatagccagaagctggaaagaacccagatgcccctcaacagaggaatggatacagaaaatgtggtacatttacacaatggaatactactcagctattaaaaaatgaatttatgaaattcctaggcaaatggatagacctggaggttatcatcctgagtgaagtaacccaatcacaaaggaactcgcacaatatgtactcactgataagtggataatagcccagacttaggatacccaagatataagatacaacttgccaaacgcatgaaattcaagaagaacgaagaccaaagtgtggacactttaccctttcttagaaatgggaacaaaacacccatagaaggagttacagagacaaaatttggagctgtgacgaagggatggaccatctagtgattgccatatgcagggatccatcccgtaatcagcttccaaatgctgacaccattgcatacactagcaagattttgctgaaaggacccagatatagctctctcttgtgagactatgccggggcctagcaaacacagaagtggatgatcacagtcagctattggatgggtcacacggcccctaatggaggagctagagaaattacccaaggagctaaagggaactgcaaccctataggtggaacaacaatatgaactaaccagtacccgggagcttttatctttagctgcatatgtatcaaaagatggcctagtcggtcatcactgcaaagaggggcccattggacttgcaaactttatatgccccagtacaggggaatgccagggccaaaaaggggcagtgggtgggtaggggattggggaggtgggtatgggggacctttgggatagcattgaaaatgtaaacgaggaaaatacctaataaaaaaaaaagatagccaaaaaaaaaaggaatgaatatttgaaaggtatctttaaaactcaaatggcaggagtattttttcaggaaggtttaaacttctccagtactggcagaagctacaaaggaactgaagaagcacagcctatataaggtggtcatccccttcattcagtatggcagaaagttggatattactatacttatatgttcattccgacattgcagcaaacttagccacacagagatacgtttttgaaagttctgccatgaggtaggaaaccagatatttccatatgcattcagagccacctatttatttttgcagatttttttccttccatgatttcatagggtacaatgcagaattttaaagtacattttaattaggtattttcttcttttacatttccaatgctatcccaaaagtaccccatactatcccccaccctctcccctacccacccactcccactttttggccctggcattcccctatactgaagcatataaagtttgcaagacaaataggcctctctttgcaatgatggccaaataggccatcttctgatacatatgcagctagagaaacgagctccgaggggtactcgttagttcatattgttattccagctataggattgcagacccctttagctctttgggtactttctctagctcctccattgggggccctgtgaaccatccaatagctgactgtgagcgtccaaatctgtgtttgctaggcccctgcatagtctcataagagacagctatatcagggtcctgtaagcaaattcttgttagtgtatgcaatggtgtcagcgtttggaggcagattatgggatggatcgcctatatggcagtctctagatggtccgaagtttcgtctcagctccaaactttgtgtctgtaactccttccttaggtgttttgttcccatttctaagaaggggcaaagtatccacactttggtcttcattcttctttagtttcattagtttcacaaattgtatcttatatcttgggtattctaagtatctgggctaacatccaattatcaatgagtacataccatgtgagttcttttgtgattgggttacctcactcaggatgatgccctccaagtccatccatttgcctaggaatttcataaattaattctttttaatagctgagtagtactccattgtgtaaatgttccacattttctgtatccattcctctgttgaggggcatctcggttttttctagcttctggctattataaataaggctgctatgaacatagtggagaatgtgtccttcttaccagttggaacatcttctggatatatgcccaggagaggtattgtgggatcctcatgtagtactatgcccaattttctgaggaaccaccagactgatttccagagtgggtgtacaagcttgaaatcccaccaacaatggaggagtgtttctctttctctacatcatcgccaccatctgctgtcacctgagtttttgatcttaaccattctgactgatgtgaagtggaatctcagtgttgttttgatttgcatttccctgatgattaatgatgctgaacattttttcaggtgcttctcagccatttggtattcctcaggtgagaattctttgttaagttctgaatgccattttttaatggggttatttgattttttggagtccaccttcttgagttctttatatatatattggatattagtcccctatctgatttaggataggtaaagatcatttcccaatctgttggtggcctttttgtcttatggatggtggcatttgccttacaaaagctttgcaattttatgaggtcccatttgtcaattctcaatcttacagcacaagccattgtgttctattcaggaatttttcccctgtgcccatatcttcgaggctttcccccactttctcctctataagtttcactgtctctttttttttttatgtggagttccttgatccacttagatttgaccttagtatgaggagataggaatggatcaattcgcatcttctacatgttaaccgccagttgtgacagaaccatttgttgaatatgcttttttccactggatggttttagctcccttttcaaaggtcaagtgaccataggtgtgtgggttcatttctgggtcttcaattctattccattagtctacttgtctgtcactataccagtaccatgcattatttttatcacaattgctctgtagtaaagctttaggtcagtcatggtgattccaccagacgttcttttatctctgagaatagtttttgctatcctaggttttttgttgttccaaatgaatttgcagattgccctttctaattcattgaagaattgagttggaattttgatggggattgcattgaatctgtagattgcttttggcaagatacccatttttactatattgatcctgccaatccatgagcatcggagatctttccacctttggagatcttctttaatttctttcttcagagacttgaagttgttatcatacagatctttcacttccttagtttctgtcatgccaaggtaatttatattatttgtgactgttgagaagggtgatgtttccctaatttctttctcagcctgtttatcctttatgtagagaaaggccattgacttgtttgacgtaattttatattcagctactttactgaagctctttatcaggtttaggagttctctggtggaatttttagggtcacttatatataatatcctatcatctgcaaaaagtgatattttgacttcttccattccaatttgtattcccttgatctccttttgttgtcgaattgctctggcaaggacttcaagtacaatgatgaatagggggggggagaaagtggacagccttgtctagtccctaatttttgtaggaatgcttccagcttctcgccatatactttcatgttgggtactggcctgctgtagattgcgtttatcatgtttaggtatgggccttggattcctgatctttccaagacttttaacatgaatgggtattggattttgtcaaatgctttctctgtgtctaacgagatgatcatgtggtttttgtctttgagtttgtttatatagaggattacattgatgtatttctgtatataaaaccatccctgcatccctggaatgaaacctacttggtcaggatggatgattgttttgatgtattggatttggttagtgagaatttttgcattgatattgatcaagtaaattggtctgaagttctctatcattgttgggtctttctgtggtttaagtatcagagtaattgtagcttcacagaatgagttggatagagtaccttctgcttctattttgtggaatagtttgtgaagaactggaattagatcttctttgaaggactggtagaactctgtactaaacccatctggtcctaggctttttttggttgggagactattaatgactgcttctatttctttcagggatataggactgtttagataattaacctgatcctgatttaactgtagtacccagcatcagtctagaaatttgtccatttcatccaggttttccagttttgttgagtatagccttttgtggaaggatctgatggtgttttggaattcttcaggatgtgttgttatttctcccttttcatttctgattttgttaattacgatgctgtccttgtgccctccagtgagtctggctaagggtttatctatcttgttgattttctcaaagaaccagctccttgtttggttgattctatgaatagttcttcttgtttccatttggttgatttcacccctgagtttgattatttctcgctgtctactcctcttgggttaatttccttccttttgttttagagcttttaggtgtgttgtcaagctgtttgtttgtgctctttctagtttctttttggaggcactcagagctatgagttttcctcttagaaatgctttcattgtgtccaataagtttgggtatgttgtggcttcattttcattaagctctaaaaagtctttaatttctttctttatccctttcttgaccaaagtatcattgagaagagtgttgttcagtttccatgtgaatgttggctctccattatttatgttgttattgaagatcatccttagtccatggtgatctgacaggatgcatgggacaatatcaatatttttgtatatgttgaggcctattttgtgaccaattataaggtcagttttggagaaggtaccatgaggtgctgagaagaaggtatatccttttgttttaggataaaatgttctgtagatatctgttaaattcataacttcttttagtttcactgtgtccctgtttagtttctgtttagacaatctgtccattgatgaaagtagagtgctgaagtctcccactattattgtgtgaggtgcaatgagtacttcgagctttactaaagtttctttagtgaatgtggctgcccttgcatttggatcatagatgttcagaattgagagttcctcttggaggattttacctttgatgtgtatgaagtgtccctccttgtcttttttgataacttttggttggaaatcgattttaatcgatattagaatgtctactccagcttgtttcttcagaccatttgcttggaaaattgttttccagcctttcattctgaggtagtgtctatctttttccctgaaatgggtttcctgtaagcagcagaatgttgggtcctgtttgtgtagctagtctgttagtctatgtctttttattggggagttgagtccattgatattaagagatattaaggaaaagtaattgttgtttcctaatttttgttgttgttgttgttgttaaagttggcattctgttcttggggctgtcgtttttttagatttcttgaaggattactttcctgctttttctaggacatggtttctgtccttgtattgttttgtttgtttgtttgtttgtttctgttattatcctttgaagggctagattcatggaaagataatgtgtgaatttggttttgttgtggaatactttggtttctccatctatggtaattaaaagtttggctgggtatagtagcctgggctggcatttgtgttctccttgtgtctgtataacatctgtccaggatcttctggctttcatagtctctggtgaaaagtctggtgtaattctgataggcctgcctttatatgttacttgaccctattcccttactgcttttaatattctatctttatttagtgcatttgctgttctgatttttttgtgttgggaggaatttcttttctggtcctgtgtatttggagttctgtatgcttcttgtatgttcatgggcatctatttctttaggtttcataagttttcttctataattttgttgaagatattttccggccctttaagttgaaaatcttcattctcatctgctcctattatccgtaggtttggtcttctcattgtgtcctggatttcctggatattttgagttaggatcttttttgcattttgcattgtctttgattgctgtgccaatgttctctatggaatcttctgtacctgagattctctcttccatctcttgtattctgttgctgatgcttgcatctatgtttccagatttctttcctaaggtttctatctccagctttgccttgctttgcattttctttattgtgttcacttccttttttaggtctagtatggttttgttcatttccatcacctgtttggatgtgttttcctcttattctttaaggacttgtaactctttagcagtgttctcctgtatttcattaagtgagttattaaagaccttcttgatatccttgaccatcatcatgagatatgcttttaaatccgggtctagctttttgggtgtgttggggtacccaggactgggtgaggtgggagtgctgtgttctgatgatggtgagtggtcttggtttctattagtaagattcttaagtttgcctttcgccatctggtaatctctggagttagttgttacagttgtttctggttagagattgttcctctcatgattctgttatcctctatcagcagacctgtgagactagatctctgactttcagtggtcagagcacacttcttacagggaaggtgcacagatatctggcattcggacctccctcctggcagaagatgaaggcccgaaagaggacctgtcccaaaagctgttttgctttggcctgtcacctaagctgttaacttctgtaatccatactcacacctacacagactagtctcagagggacccgggaatcaaaatacctcccccaggtgctccagcatagccctccctggcagggtggacacctctcctctggcagggaaggtgcccggatctctggagcctgaaacagggtctgtctcagaagctgtctctagggaccttggagtttccacctactctgtgcccaggtgaccaagtgctggcactgaccggaagggatttgtgaccctggtcagtccgggttttctgcttctctaatgctgtctcaagtcccgtgcaattggattggaacagaagttgtattccactcaccagtggtcctaagatcacgtggagagtcctctaggggaccttgggggtgttttaaagtacatttaacaattccttttgcatttccctttgcaatgtagaatttgacttgtgaaaaaaggatattacttaatcaacatcatatttacctaaaggctattacttaatcaatatcatatttacatttattggaaaataatagaatgtacaagcatttaaaagcaggaggcttttcgcatttttctggttgtactttcatttgtacgttcagcaggcatgtaaatcaccaaagcttagagttgcataaaagagctggaatgatacttctctgttttgaattatgatacgactctgcaagaggatctcccaaaactcatgtaaggaatctcaaaactctattactgcagatttagaaacataaacaccctttgaaatctatacacacctacatataggctcataatacacatacaggcacacatacacacacaaaaaaagatgcagacacagaaagaaatatgcacacatggttaacattaataaaacatagctaactgtggtggctaacaacttctagcatttaacagtcagaagctgataaatttctgagttcaaagccagcctgatctacaaagtgggtttgatttagcaaattctaattagtaagatcctgtctaaaaaacaaaaccaaaacaaacaagccaacaagcaaacaaataagaatgtcatagcaacaatttgtaaaatataaggaaaaaatgcagcactgaatgataaatcaatgctttcattaaacaacaaagtttatgttcatggtaagggtggcatttacatgaacacataggaaattttaaaaaagacacctaatcttatagtatgacaattatttagtgctttgtacattccctagtgtaggttacattttgcataagaactctttcctttgtatagagatctaaacatgaatataaatcattattgtacaggcacaattgtccacatagcaccttcactttattcctgaccaatttatacagggatttatgaagaacctcctttttcatactagcaatagaacagcttacagctcatggccacctgcgtttgtcattagctttagaaaagatttcgagtccctgcagactggcaaacatgcacgcatgcgtgattggagggctgtgcaggctcactagcacagaatgggggttgggagtgtgattagtcaagtcagtgcagcaggtcctgctcagagaagaggcaggcaaacatgcctgtcacatccaccctaggaatggtcagcaaggcaatgcagcaaacaaggtcagctcccactttgaccccttgtttctttcacagtagaacatgatttgtgcacattaagtactgcaaatttattgggattagaacattattctatagatctcaatctttagctaaagaatcagatgagatcgggacctggcttcctttgtcctgtcctgtattatgttggctgcagtgctcctccccttgagccttcaatctgccctgtcacttcagctcagttctcttacagggtgaaaattaacatttcaaagagctgacagtattgtggattattggtgtgtgggactaagagccatcagagaaatagaatatttttatttgtctatgaaagttagatgaaaataatatccttaagggaatctaaattaggtactgtcatgctctgaaggatgggatgggataattgcacttgagcatttacaaacagattattttcagaggaaagacacaacagataatggtagtttgcacctcccagtttctggatgcatagaaggatcaagtacatatgagtttcaacactatgatgcctataataaaagaaagagcatccaaagtgcttttgagaaaaatagtggacaaagttaattcaggtgtgtgaactgccaatttgtggaaatgttgtgtgtcattacatacagatatagcttacatagtggtatagaactataaactttttctgtcattttgtaagttgatgtatcttgaatattgttaaactgcttcagtgtcattagatagtagggttggttttttgtttgtttgtttgtttgtttttttgtaatcttacccagattcaaaaataacctggtgaattaggaagtactttctttggacatttaatttatacttcatgctcgaatctcctgattttgattacatttatcagttatgcaaagtagcatgaagaatttttttgttttttgtgttttggttttggtttttggtttttgggttttgttttgttttgttttgttttgttttgttttgttttttgtttttagagacagggtttctctgagtagccctggatgtcctggaactcactttgtagaccaggctggcctcgaactcagaaatcggcctgcctctgcctcccaactactgggattaaagtcgtgtgccaccatgcccagctgcatgaagaatttttttgaccatactctgacagataaattcacatgatgtgagagaccaaaccgtgggaaactaggtcctgccagtaactctcaccctaaagatccggctgaccctttgaagggaattatgtcactccctccttcattgtctccacctggtgcctgagactgccagcttcactccctccttcactggcgcctagaactgcttagattacggcagcttcacctcctcctccatgtctctttttggtgctctggactgtttcatcaggacaggcactccaagataaactgcagaatgtttgaaggccgcccgggactgttagggggctgacattccaagataagctatgagaagcctgtaataagcattcgccccagatgtccatccctttctctgtattttattatgccccctcgacccctccctattttatctcactgtatgcttataatcaggctcctagccttcattaaacagaccttgacaacactttgcttggtcttgctcccctttctccacccacttctcttgtaggcctctgtcctcctggacccacagaataactaggtcctgctggacgggacaatatgaatgtgccttgctttttgtttttgtttggttatttaaaggtcttattgaaattgtattttagttttcatttcaaaatgatgttgtattttttacaacagttataacaacttttttattagctattttctttatttacatttcaaatgttattccctttcctagttttccctctgaaaatcccttatcccctccccacttctcctgctccccaacccacccactcccattcctggtcctggcattcccctatactggggcatagaaacttcacaggaccaaggacctcttctcctgttgatgaccaactaggccatcctctgctacatatataactagagctaaagttccaccatgtgttttctttgattggtggtagagttccaaggagctctggggttagttcatactgatgttcctcctatagggcttcagtccccttcagctcgctggccatcttctgctacatatgcagctagaggcacaagctctgggggcactgcttagttcatatttttgttcctcctatagggttgcagaccccttcagctccttgggtactttctctagctcctcaattgcgggccctgtgtttcatctaatagatgactgtgagcatctgcttctgtatttaccaggcactggcatagcctcacaagagacagctatatcagggtcatttcaacaaaatcttgctggtgtatgcaatagtgtctgcgtttggtggctgattatgagatggatccccaggtggggtagtctctggatagtccaacctttcatcttagcaccaaactttggctctgtaactcctttcatgggtattttgttccctattctaagagggaatgaagtatccacaaatggctaagatcaaaaattcatgtaacagcagatgctggtgaggatgtggagaaagagaaacattcctccattgctggtgggattgcaagtttgtacaaccactctggaaatcagtctggagtacccaatcacaaaagaaggcacttgatatgcattcactgataagaagaaggaagaccaatacgtgaatatttcatctctttggtctatcttcttgattttcatgtgttttgcaaattgtatcttgggtattctaggtttctgggttagtatccacttatcagtgagtgcatatcaagtgagttattttgtgattgggttacctcactcaggatgatatccttcagatccatttgcctagtaatttcatacattgttttttaatagctgagtagtactccaatgtgcaaatgtagcacattttctgtatcgattcctctgttgagggacatctgggttctttccagcttctggctattataaataaggctgctatgaacatagtggagcatgtttccttatcacaagttggaacatcttctgggtatatgcccaggagaggtattgctggatcctccagtaataatatatccaattttctgaggaactgccagactgatttccagagtggttgtataagcttgcaataccaccaacagtggaggagtgttcccctttcaccacatcctcaccagcatctgctgtcacacgaattttggatcttagccattctgactgttgtgaggttgaatctctgagttattttgatttgcattgccttgatgattaaggatgttggacatttttttcaggtgcttttcagtcagttgagaattctttgtttagttttgtaccccatatttaatgggattattttattctctggagtccagcttcttgaattctttgtatatattgaatattagtcccctatctaatttaggattggtaatgattctttcccaatctgttggtggcctttttgtcttattaacagtgtcttttgccttacaaaagctttgtaatttcatgaggtcccatttgtcgattctggatcttacaggacaggccagttgttcttctgttcaggaattttttccctagtgcccatatcttcgaggctttttcccaccatatcctttataagttttagtgtctctggttttatgtggagtcccttgatccacataaaagtaattttatacagtatattattattaaagtttcccttttatctattccacctagcgccttcccacatacccttcctttcacattagctcttttcctatctttccctagaaaagcacatacaataaacagcaatcaaacttatcaaaatgaaatataataagatcaaaagacattatattgagagtggacaaggcaacccaacagaagaaaaagtaccacaggtacaggcacaagaatcagacacctacttgttaatacactcagaaatgccataaatacactaaaataaatgttatttccacagaggacccaagtgcagacttaggctctggatgagagaggctcacatagtcatgtccttctttgtctctcattgtattttgttttttacttcaaaatgttgtttagatttaagatttttttctttttttaaatttatttatttttattaggtattttctttttctttttttttaaatattttttattattacatattttcctcatgtatttccaaagtggaattagatggtgactcatgccagcagcactctgagtttgtagcttctcaagcagtgctaattaatgcagttatggatcagtaagcagcataccatacacattgtctgtagcatacatttaaatatggtatgggaatatctcttgcaactctttattttgcaactcttttatgatttaagttttttctacagtgagaattttgtttccatattcataaatttacaattttaggattagtttgggtgaagtattttattgattcttatattgaatgtgcatcattattcatgctttctgagatcctttgacttatattccctagtggatgaatccttgtatgtcataagatttttataataactcataccttcttggagtagtatttgcactaaattagatatttctgtttaaacgaccatcaatatatatgtacatatgtaaaattaaatctttatattatatgtaaaaataaatattatatattacttatacaatatataatatattacaataaaatattatgtaaaataaaatatataatatgtaaattctatgattatcatatgtaatataatatataataattcaagactaaatgaaatacttaactacaaaatatagcctagttgtacttcttgagtatggatatatatatatatatatatatatatacacacacacacatatatgtatatatataaaatgaatatatgtacacaaacacaaatatatatatatattatataatacataaggtacactttacatacatattttatatatatatatatatatatatatatatatatatatatatataatatttgggaaaactatatatatatatccatataaatatctctacattttcatcaagtatagttattttttatattttgtagctataggtagtttattgtttattataatacatattatactacatattataattataaaaattgtgttgtaaacattcatatatatataaataagtatatagctacaataaagtacttaggtacttcatataacatatacatatatatgtatagctttcttaaaatttttcatatatccttagttttgcttaacacaatttacttatttcacccaacttcaacatttatccccattcctgatagaacatgtagcttccagtactctttttatattattttatatagcatatacatgaatgttcttacttactattatgttaaatagtataagctagtatataatctcccaaataacttctatatgtacatttcacttgattaaaccttgctgtggactctgattttaccaaatcctatctgtcctagtcagggtttctatgcctgcacaaacatcatgaccaaggagttggggagaaaagggtttattcagcttacacttccatactgctgttcatcaccaaaggaagtcaggactggaactcaagcaggtcccaaagttccacagtcctccccaaaacatggtcaggttgtcacaggaataccccacgatgatggtaccaattcccaacaatggttcagtagtagttgtgaatggaagtccaatctagcaataatctaccagttactcagtcccacatggcaagcaggcaaaggagcgagagcgagactcccttcttccaatgtccttatatggtcatcagcagaaggtgtagcccagattaaaggtgtgttccaccacacctttaattccagatgaccttgaactcggagatctccctgtcttaatcttctgtaatccatagccactatgcctcaagatctccataccaagatccagatcagaaatatctatctcccagcctccagattagggtcacttgtgagccttccaattctggattgcagttcattctaaatatagtcaagttgacaaccaggaatagccactacactatcatactactatccacataaatcttctggctccagaaatcccctttctactttcatttcctagatataatactcccactcctctctaaacatattcctctatgctaatgactagctttcagtatcatattttcacatagcctccatcaaacctcccaaaacaaaagtccttatgtaggcacctcgtatggagagaaaggggagcatttgtcttcttccggtttgattgatagtactcactgttactggttcttttcctttccatctatccacctgcaaatttcaatttttgttattgaacattatttaactgcatatggacacaatatatgtctaaaataaatatataaaaagcattttcataataaatattcactctgtgtgtgtgtttgtgtgtgtgtgtgtgtgtgtgtgtgtgtgtgtgtgtatgacacacacctaccaacagtacctatgcaaagtcagaggagaaaccatcgtaagtttcttttctcctattgtcttctgagatatacatatttactaaggatcacttatggagaaagaggagagacatctacatttttcatgttcaaattattcatatatgtacatatgtgtgtaatgaatcgttatgtaaggagcattgttagcattttcattttctgaaacatttataatatctttatgttgatgaatttcttttttttttttttttttttttttttttttgaagttagaaaagtcttttaagtttttaaattaaaattgcaccctgtccgggacccgccgaacttaggaaattagtctgaacaggtgagagggtgcgccagagaacctgacagcttctggaacaggcggaagcacagaggcgctgaggcagcaccctgtgtgggccggggacagccggccaccttccggaccagaggacaggtgcccgcccagctggggaggcggcctaagccacagcagcagcggtcgccatcttggtccgggacccgccgaacttaggaaattagtctgaacaggtgagagggtgcgccagagaacctaacagcttctggaacaggcggaagcacagaggcgctgaggcagcaccctgtgtgggccggggacagccggccaccttccggaccagaggacaggtgcccacccagctggggaggcggcctaagccacagcagcagcggtcgccatcttggtccgggacccgccgaacttaggaaattagtctgaacaggtgagagggtgcgccagagaacctgacagcctctggaacaggcagaagcacagaggggctgaggcagcaccctgtgtgggccggggacagccggccaccttccggaccggaggacaggtgcccgcccggctggggaggcgacctaagccacagcagcagcggtcgccatcttggtccgggacccgccgaacttaggaaattagtctgaacaggtgagagggtgcgccagagaacctgacagcttctggaacaggcggaagcacagaggcgctgaggcagcaccctttgtgggccggggacagccggccaccttccggaccggaggacaggtgcccgcccggctggggaggcggcctaagccacagcagcagcggtcgccatcttggtccgagacccgccgaacttaggaaattagtctgaacaggtgagagggtgcgccagagaacctgacagcttctggaacaggcggaagcacagaggcgctgaggcagcaccctgtgtgggccggggacagccggccaccttccggaccggaggacaggtgcccacccggctggggaggcggcctaagccacagcagcagcggtcgccatcttggtcccgggactccaaggaacttaggaatttagtctgcttaggtgagagtctgtaccacctgggaactgccaaagcaacacagtgtctgagaaaggtcctgttttgggccttcttcttcggccaggaggaggtccaaatacaagatatctgcgcaccttccctgtaagagagcttgccagcagagagtgctctgagcactgaaactcagaggagagaatctgtctcccaggtctgctgatagacggtaacagaatcaccagaagaacaatctctaaacagagtcaactataactactaactccagagattaccagatggcgaaaggtaaacggaggaatcttactaacaggaaccaagaccactcaccatcaccagaacccagcacacccacttcgcccagtccagggaaccccaacacacctgagaacctagacctagatttaaaagcatatctcatgatgatggtagaggacatcaagaaggactttaataaatcacttaaagaaatacaggagaacactgctaaagagttacaagtccttaaagaaaaacaggaaaacacaatcaaacaggtagaagtccttacagaaaaagaggaaaaaacatacaaacaggtgatggaaatgaacaaaaccatactagacctaaaaagggaagtagacacaataaagaaaactcaaagcgaggcaacactagagatagaaaccctaggaaagaaatctggaaccatagatttgagcatcagcaacagaatacaagaaatggaagagagaatctcaggtgcagaagattccatagagaacatcagcacaacaatcaaagaaaatggaaaatgcaaaaagatcctaactcaaaatatccaggaaatccaggacacaataagaagaccaaatgtacggataataggagtggatgagaatgaagattttcaactcaaaggtccagcaaacatcttcaacaaaattattgaagaaaacttcccaaatctaaagaatgagatgcatatgaacatacaagaagcctacagaactccaaatagactggaccagaaaagaaattcctcccgacacataataatcagaacatcaaatgcactaaataaagatagaatactaaaagcagtaagggaaaaaggtcaagtaacatataaaggcaagcctatcagaattacaccagatttttcaccagagactatgaaagccagaagagcctggacagatgttatacagacactaagagaacacaaactgcagcccaggctactatacccagccaaactctcaattatcatagagggagaaaccaaagtattccacgacaaaaccaaattcacgcattatctctccacgaatccagcccttcaaaggataataacagaaaaaaaccaatacaagaacgggaacaacgccctagaaaaaacaagaaggtaatccctcaacaaacctaaaagaagacagccacaagaacagaatgccacctttaacaactaaaataacaggaagcaacaattacttttccttaatatctcttaacatcaatggtctcaactcgccaataaaaagacatagactaacaaactggctacacaaacaagacccaacattttgctgcttacaggaaactcatctcagagaaaaagatagacactacctcagaatgaaaggctggaaaacaattttccaagcaaatggtatgaagaaacaagcaggagtagccatcctaatatctgataagattgacttccaacccaaagtcatcaaaaaagacaaggagggacacttcattctcatcaaaggtaaaatcctccaagaggaactctcaattctgaatatctatgctccaaatataagagcagccacattcactaaagaaactttagtaaagctcaaagcacacattgcgcctcacacaataatagtgggagacttcaacacaccactttcaccaatggacagatcatggaaacagaaactaaacagggacacactgaaactaacagaagtgatgaaacaaatggatctgacagatatctacagaacattttatcctaaaacaaaaggatataccttcttctcagcacctcatggtaccttctccaaaattgaccacataataggtcacaaatcaggcctcaacagattcaaaaatattgaaattgtcccatgtatcctatcagatcaccatgcactaaggctgatcttcaataacaaaataaataacagaaagccaacattcacatggaaactgaacaacactcttctcaatgataccttggtcaaggaaggaataaagaaagaaattaaagactttttagagtttaatgaaaatgaagccacaacgtacccaaacctttgggacacaatgaaagcatttctaagagggaaactcatagctatgagtgccttcaagaaaaaacgggagagagcacatactagcagcttgacaacacatctaaaagctctagaaaaaaaggaagcaaattcacccaagaggagtagacggcaggaaataatcaaactcaggggtgaaatcaaccaagtggaaacaagaagaactattcaaagaattaaccaaacgaggagttggttctttgagaaaatcaacaagatagataaacccttagctagactcactaaagggcacagggacaaaatcctaattaacaaaatcagaaatgaaaagggagacataacaacagatcctgaagaaatccaaaacaccatcagatccttctacaaaaggctatactcaacaaaactggacaacctggacgaaatggacaaatttctggacagataccaggtaccaaagttgaatcaggatcaagttgaccttctaaacagtcccatatcccctaaagaaatagaagcagttattaatagtctcccagccaaaaaaagcccaggaccagacgggtttagtgcagagttctatcagaccttcaaagaagatctaactccagttctgcacaaactttttcacaagatagaagtagaaggtattctacccaactcattttatgaagccactattactctgatacctaaaccacagaaagatccaacaaagatagagaacttcagaccaatttctcttatgaacatcgatgcaaaaattcttaataaaattctcgctaaccgaatccaagaacacattaaagcaatcatccatcctgaccaagtaggttttattccagggatgcagggatggtttaatatacgaaaatccatcaatgtaatccattatataaacaaactcaaagacaaaaaccacatgatcatctcgttagatgcagaaaaagcatttgacaagatccaacacccattcatgataaaagttctggaaagatcaggaattcaaggccaatacctaaacatgataaaagcaatctacagcaaaccagtagccaacatcaaagtaaatggagagaagctggaagcaatcccactaaaatcagggactagacaaggctgcccactttctccctaccttttcaacatagtacttgaagtattagccagagcaattcgacaacaaaaggagatcaaggggatacaaattggaaaagaggaagtcaaaatatcactttttgcagatgatatgatagtatatataagtgaccctaaaaattccaacagagaactcctaaacctgataaacagcttcggtgaagtagctggatataaaattaactcaaacaagtcaatggcctttctctacacaaagaataaacaggctgagaaagaaattagggaaacaacacccttctcaatagccacaaataatataaaatatctcggcgtgactctaacgaaggaagtgaaagatctgtatgataaaaacttcaagtccctgaagaaagaaattaaagaagatctcagaagatggaaagatctcccatgctcatggattggcaggaccaacattgtaaaaatggctatcttgccaaaagcaatctacagattcaatgcaatccccattaaaattccaactcaattcttcaacgaactagaaggagcaatttgcaaattcatctggaataacaaaaaaccgaggatagcaaaaactcttctcaaggataaaagaacctctggtggaatcaccatgcctgacctaaagctttactacagagcaattgtgataaaaactgcatggtactggtatagagacagacaagtggaccaatggaatagaattgaagacccagaaatgaacccacacacctatggtcacttgatcttcgacaagggagccaaaaccatccagtggaagaaagacagcattttcaacaattggtgctggcacaactggttgttatcatgtagaagaatgcgaatcgatccatacttatctccttgtactaaggtcaaatctaagtggatcaaggaacttcacataaaaccagagacactgaaacttatagaggagaaagtggggaaaagccttgaagatatgggcacaggggaaaaattcctgaacagaacagcaatggcttgtgctgtaagatcgagaattgacaaatgggacctaatgaaactccaaagtttctgcaaggcaaaagacactgtctataagacaaaaagaccaccaacagactgggaaaggatctttacctatcctaaatcagataggggactaatatccaacatatataaagaactcaagaaggtggacctcagaaaatcaaataacccccttaaaaaatggggctcagaactgaacaaagaattctcacctgaggaataccgaatggcagagaagcacctgaaaaaatgttcaacatccttaatcatcagggaaatgcaaatcaaaacaaccctgagattccacctcacaccagtcagaatggctaagatcaaaaattcaggtgacagcagatgctggcgaggatgtggagaaagaggaacactcctccattgttggtgggattgcaggcttgtacaaccactctggaaatcagtctggcggttcctcagaaaattggacatagtactaccggaggatccagcaatacctctcctgggcatatatccagaagaagccccaactggtaagaaggacacatgctccactatgttcatagcagccttatttataatagccagaaactggaaagaacccagatgcccctcaacagaggaatggatacagaaaatgtggtacatctacacaatggagtactactcagctattaaaaagaatgaatttatgaaattcctagccaaatggatggacctggagagcatcatcctgagtgaggtaacacaatcacaaaggaactcacacaatatgtactcactgataagtggatactagcccaaaacctaggatacccacgatataagatacaatttcctaaacacatgaaactcaagaaaaatgaagactgaagtgtggacactatgcccctccttagaagtgggaacaaaacacccatggaaggagttacagaaacaaagtatggagctgagatgaaaggatggaccatgtagagactgccatatccagggatccaccccataatcagcttccaaatgctgacaccattgcatacactagcaagattttactgaaaggacccagatgtagctgtctcttgtgagactatgccggggcctagcaaacacagaagtggatgctcacagtcagctaatggatggatcacagggctcccaatggaggagctagagaaagtacccaaggagctaaagggatcttcaaccctataggtggaacaacattatgaactaaccagtacccctgagctcttgactctagctgcatatgtatcaaaagatggcctagtcggccatcactggaaagagaggcccattggacacgcagactttgtgtgccccggtacaggggaacgccagggccaaagggggggagtgggtgggtaggggagtgggggtgggtgggtaagggggtcttttggtatagcattggaaatgtaaatgagctaaatacctaataaaaaatggaaaaaaaaaaaaaaattgcaccctggtgcgatgactctaatttgggaactcatccaaaggcagactctcctgagtgctggtcctctggcctggacacacagagactgggagcctgtcggacagttagaacagggaaggggcagaagcacccacatcagagggcagccaagtcttgacatctagctggtgacaaggtgacaagtttcagagtcaacaagaggccaccaccagcagagatgaaaattgtctaccagcaatggggtagaagtccatgattctgaggaccctcctgggtgcacctcctttggcggtggggcttcctaatggctggcacgccttctcacagagcagcacagccacgcggctgcaagctcgctccatctgtgaacacccttttgttcccctcaattgggcagagaaagaggtgctggcaaggaatgtgagccttgcctctgacaggaacacgtgtgcaggccccactctcacaaacattagctaaatttatattcatatatattatagttatatattaaaaagaggaaaaaaaaactttccctaagagaaactcctgaagaacccaagtggctcaggacgtttactgtcccccccccccccaaaactcttataaaatcttccagtgcgatcgtgaagaaaccccccgccctcttgcgttcctcccctcccagccctcatctgtgtccccacaaccctggactgccccctgctccagcccagtggcgtccagtctcatctctggccatccatggctgccatggctttctgaggggcgcccccctgcgatgctctggggggccacgtgggctgtgggcagtggagatggaaggtgttgggggaagagggcgggatccagggcacctggtgattgggtggggatgcggcccagaaggggctgaagtttgcagggggggaacaggccacggctgccatggggctgctgctgctgctctgcaggccctcagaggttcgaagcttggagaacatggccaatgcatcagggaagttgggtggtgtagcaggggtgttgctgggggtacacatcatctgcgggtggtggtggctgttgggaatgttgctttcttgaaagaacgtgcttagggcggtctcgaactgccagtgcgccgcttgcagcagctgctgcgcctgatcggccgcgcagcccgcggccagcacgaactggttgatcatgacctggtgccgcagctcgtccgtgttcaccgacatggcgctgggcggccgccccgggctcacgctcgcagctccgccgccgcccggctcgcgcggccgcgccgacgccgcaaaccatgttgatgaatttcaatgcactccccagatgactcctataggatgctgaaagatgaaatatctaacaacaatcagaaagtagttagaaggaagagagtcagcacaagacttttaattgtagaacccactgcacatgatatatttccaccagcaaggatacaccagaaaaaccatacaaaagaaatccaccaactaggaaccaagtgttcaaataatagaatctgtgaggaacatttcttattcaatctatcagaactactccctgatctttgcctgccaatccagttcaacctctctcatattcttcaggaaaatatcatggcccttgtcaccccattaaccaaactaaaggctgaaaaggctgagggctgggcaaataatatctgtccacagcttaacttggtacaggaatagacaaactgcacattctgggatatatatttgcctacccgtaggacaaagaaaacctataaaaatattttttcagcaaatagtgttctcattgtgtagcccagattaatatgtgctgactaggtagacctagctaaactttacctcacagagattttcctctgtcttccctactctggagttaaagtcataatccaccatacttggcctcaatcttcatctttatcttctgaattatgtgatgttctaaaatttgctatacaaggttaaaaatctccccttaggttatgaatacagactttggctttttgataacatttccccccacgtattcatgaagaataccttgcaagatgaaatgcagtgggcaagtgagcttcctggatacagcccatggtttgctcaaatgcaatgggtgtaatttagaaaggcaaaccccagaagcttcatctttaaattgcttgtcactgctgctgtgccttttcatgctttttattgttgtattcttcatatatttagcagattgtgattggactggtgagaccctcactgcctataaaatggtgttattatccctcatgaaataacccacagtatgggacaattttcctgcattggatagttttcctgtagatcaatatgacagtcaactttcagaaactaatattgtatagataaatttatggtttaaaaaattcatttttgattaaaatagatttaagaagttagagaagaatatagaaagtttaagaaggtggtttaaaggggctggagagatagatcagctgtttagagaactgactgttcttccagaggtcctgagttcaattcgcagcaacaacatggtggctcacaacaagctgttatggggatttgatactctcgtctggggtgtctaaagacaactacagtgtactcatgcgcctaaaataaacaaacaaacaaatgaatgaataaataaataaataaatattttttaaaaaaagaaaatggtttaagttgtgttgccagatagatataataaagttagaattaatagcagattgtttataatcccttttagaatacttagagcagcagagtttagaagagaaatacagtgagctgttatttgttgcaaacatgtaactgtacttggaagacaaaaatgccttggaagtagttaatgattaaagaaaaagaaaaaagaaacatatcattccaggttggttctgaattgctagatcatttgctctatagagctagccacaggatttggtgtacattatgaaagacaaagatataaataaagaataaataactgtatcataagtacagagaatagatgattatttggtttggctgaataagacatgtgataaatgatgatctttttcttggtgagtacaaattgtcatgagttaggaataggaaaagacttgattctatatgtcgctttgcttaaactttgataaccaataagaaaagaagtattgctttggggttaagatgaagctgtggagagaagtgttggcccagtaattcaatatattttccttgagaaaaaagtgaactgagtaattaattatagagtcctcaagcagtcttcaggtttccctgtagtgtcaatagtactcttgaacacatttagtactcaagtctctcactggtccaggaataaacactgaaagagattttgccttcctgtgcaagtcctggttccctattggtagttttggatttcatgaagtttaagtcccatgctagtgtaaaccctttgatttttcttcctccactgactaagtaatgatcttaatattccattggggcatgaaatattaatttttataatctcagttactatggtaatgcatgactcccttgtgttttccactacctgataatcatgtggaccttatactgtaatggccaagtagatatacggttcttacaatgaagagactcatttaacacaggttttagagctctagtctcaatgaggactgatttgtatatcacctggatttctaattcccacaacactcagaatgcccatatccaatcccaggccatatagtatcatgaggtcagtttaaatagactctattatttttatttataagttctccaagtggagtatagtgataaagcccaccttttagcctagtttgtatcactactgctatgtagtacagctagaggtcaggaatgttgattccacccaaagttatcttatgttcaggattgtttgtctgtcctgaattatttttccatatgaagttgaaaatcattgctagagatttttatatatttgtttaatgtacttgtttgtgatatagattccagatatctagtttaggtctctaagcttgtataataggtacttaaatcaccaagatgggtcattggtgcatttccattaacagtattgcattaaataattaaatgcacataaggcaattaccatatcatcctggtaatatatgttcatttttatggttacttttcaggacaatatccaacaagtggaaatgggcgtcatttccttaaaacgttgttagacatattcaattaatttacttcaaatgatcaatgtaatctattttttttaaaaatcattttacttacttgacattttattatctatgttttactttcaaagacccacaggctgttgtaaatggacacaactaccatgaacatataagtaaatcttcaacctgtttttattttaataacattatggaaaacttcttacaatatatattatataccagggtatatgattgtgacttgaaacacaaccagtattttgaaatctgctgtgtcgcttacatggaagaaaagcatgagttatgccaaaatcctgataatggaaagaagttgcactgtgaatagggaattattctgtcacaaggaactgagcctgtgtggaagagtctgttttctccaataaagtgtgtaggatatagaaaaatatttgtaattaagatatttcttttggtttccttcagaaagcatctaggtttcattgctatttgcagtaaaaaatggtgtgttttgacttattggagtgcttgttattggaaaatctagcggcctttgcttttccatgtctgggttacatgacatggcatgattatgtgttctcactcaattcacttctgttttccatttatttgtatatttattcattttacattacaatctctgatttctctcctggtctgccgttcacagggtccttccctgctaacctccttcctcttatattctgagagggtgtaggccacagtggatattcccctaacatgatacctcacgtctatgaagacaaggtatatcctctcccactgagggcaaaaaagaatctcagctaaaggaatgtattctacacaggcaacatatttagagtcatcccctactccagatgttctaggacccacatgaataatgagctccacatctgctacatatgtacagagggcataagttcagccaatgtttgctctttggttgctgattcagtctctaagagaacctagtatccaggttagctgattctattcagttttcagtggatttactatctccttcttagccctcaacccttccccaaaccttccataaaattccaagagctccaagcaatgttcagctttgagtctctgcatctatttctgtctcatactgtatgcagcttctcagaggaggtttctgtctgcaagcacagcagaatatcattaagagtgtcagggattggtgcttgcctatgggatatgtctcaagttggtcaggtttttgtttgtccattccctggatatatgttcaatctttgtccctgcatttcttgtacataggacatactttgagtcaaatgttttacatgtgggttggtctccttgtcactccacttacatacctgcctggacactggaaatacccctttcaagctccatattccacaagagaggaatttaaattgtaatacatccttatcttttctcttttgtaatttaactatctactggcctggatttgcttctgtcctggatgtgtcctgatgccttgttcaccaggctggaagggaaagaatgaatcttagctgggccagatggtttggagaagaaattggtctgtctgattattggattaacagccttctccagagatggttttcacctaaactgcttttctttatgggggtaagaagagttatataaacttttaggaagagattggagtttggaggtgtgtatgtattattagctgtggctgaactgccagggatgcttttttttttgttgttgttgttttttgttgtttttttttttttttttttttttttttttgcctaaagaagaatcccagacgcttactatacttaccttgttagtgagagaagtttacacagtaatttggctaccagactatgtgacacactcaaaagtgatggaggtggcggtcataaaacctatgttctctgggacaaacaagcccagagcaagatggaaaacagtcctactcctgctgattttcagtgacctcacacttactccagactggctcccccagacactcctttctgggcctaaaaactatcctctaaaatttccatactgaaactgactatgacaaaataatgggtcaaataaaattgttaattacagatggcttagcagtcaagagcaccaactgctcttctaaaggtcctgagttcaatatccagcaaccaaatggtgactcattagcttggttagtcacacgaaggtattttatattatttgtgacttttgtaaagggtgtcctttccctacttttttcttagcctgtttattcctagagtagagaaaggatactgatttgagttaattttatatccaggcactattctggagttgtttataaggtttaggagttctctgatgaaatttttgagtcacttaaatctaacactgtatcatctgcaaatagtggttgtttgacttttcctatacaatttatatccacttgacctccttttgttgtctaattgctctggctaggactttgagcactatattgaatcggtagggagagagtaggcagtcttgtcaggtccctgattttagtagaattgcttcaagtttctcttcatttagtttgatgtcggcaagtggtttgctatatattccttttactatgttttggtatgggccttgaattcctgatccttccaagacttttaacacaaaggggatgttgaattttgtcaaatgctttttgagcatctaatgaaatgtaggattttttccttgagtttgtttatgtagtgttttacattgatggatttctgtatattgaaccatctctgcatccctgggatgaagactgcttgattgccatgaatgatcattttgatgtgtttttggattcagttggcatggattttattgagtatttttgcatccgtattcataagggaaatttgtctgaagttctctttctttgttgcatctttgtgtgcttttggtatcagcgtaattctggcttcatagaatgaattggatagtgttccttctgtttctattttgtggaatagtgtttagagtattggtattaggtcttcttgaaagtctgatagaattctgcactaaaaccatctggtccttggctttttttggtagggagacttgtaatgacttcttctatttctttaggggtatgggacagcttagatggtttatctgatcctgatttacctttggtgtttagtctctgtctagaaaattgttcatttcatccagattttccagttgtgttgaatataggctattgtagcaggatctgaatatttttttttaatttctacacgttctgttgttgggtccccccctttcatttatgtttttgttatttgtgtattttgtctgtgccctctggtaagtctggctaagtgttcatctgtcctttttatttttttcaaagaaccagctcctggtattgttgaatcgtcatgtagttgtttttgtttgtttgtttgtttctagttggttgattacagtcctgagtttggttgtttcctgctgtctactaattttgggtgtatttgattctttttgttctagagctttcagatgtaaggtactactggggtaaactagttttttttttttttcatttggagaatttgtgaaatggagatactttcttggtattatttctgctctcagtgcatggatcccaaataactttgacctatacagaccctgtgcaagtgtcattctctgtaggatttcatatatgcatcagccctataatgtctggtaggagttgttaccttgttggcattgctccaaacaccattggccttagtgtcattctacaatgtattctacaaatttcactgagtcatgaaggaggagtttgcatagcaatatatgaattatgattggatgagccaaagtcttttactctgcacattgtccggttataggtctatgtatctggcctcatctaatgtatatattagcttctatgatgaaggtgcaatggtataatgaactatgggtataacagaatgtttgtattggtccatatcataagcagacaatggtacatgtttttaccttattctcaggtattttgccatgagaactacatcaaaaatgtattttgtctcatggagtagtcctctaatccagtcagatagtaattgcttaaccctcaaaagggcaactattacagcagagtatcatattggcagctgtcctgtctgtggcagatcaaagagtatagagctgggtttgttgtttaaatttcccctcaggaaccattcggaataattttcaatgccagcaacactatgcagaaggtaaaggttttagttaggcacctgcttatcttttctatgtttaataaaaatgtaagtgtaatctgcattagagctatcattggtttgtgaagagcaatcaacagcttaggcaatattctgagttgtgtgggaggtaacgggtaactcaggatgagttttttctgctgcatttctctgagttttattactttttaacagtttagtaatattccattgtgtgatgtaccacattttcattaaccatttcctcatttataggcagttaggctgtctcttcttcctactaatatgaatatacatgcaatgaatagaaatgagtaagtgtctatatagtatgatatggacttcttttttttggagatatgcccaaaatattataccgggatattgaggaacaacattcccaggttcccaaggcaaaatcacactgacttccaaaagctgaactactgtgtatttcgaccagcagaaaataaggattcttattattcatcatcctcccttgcacatatggtcatttcttttattgatcttccccatattatttacctaaagattaaatatcaatgtgccttgaatatgcatattgctgattaatgagaatgttgaacatttcttttagtgaaataaacatttgaatggtcaattatgtgtcattagaggaggagatttatagttgaatataaaaaggataaatagaggaaagccatggaaattagaggtacagaggacattagtattcagagagaaatcatagcaagccagactaccaaaacctttaagacatacttcagactaggatattaagcaatattacttcgtgtgtgtgtgtgtgcctgcaaatttgttctttagtatcataagagagcccagcaggctgataaatacaatgtttttaatgaatttaggaaacatctggttcataagtcaaggaggagaaactctgaaggtctaagcatcatggacagattttttttccatagggaaaaaagcatgtgataggaaaatcaaagagcctacagcaaagtaaattgtcattaaaagtgtattctcagggcagaaactctctttacttctcctagatcttagacacagaattccttcttgccattaaaaccacaagtcaagtgatacatgaaggcatgattacctctgtgttcatagtgccatgtagcttttgagtaaacagtaagattgatggaaaaaaaactacagaaagttctttgcagaatgcagatggatagggactatgaaatgactgtgcaattttcaaaggacttaaacagtcatctcatagccaaattcaatccctgatatctataagggacatctaaggtatgttccacttctgagatataggaagaataatacaggacactgttatctggcatatcacattacactacaatttatataacaaagagggctttattagacagtgttgaagctgcttgctctttaaaatatcccttcattgggagagttgccacatttaattttctcagccaacatggaagagacagtacttctggcaacggtaattgcaaatacctcccacagtgatagtcattatgacctctggattgacccaggaaatgtgcttatttttttcattaggactgagcaagtagctttgtacaggtgtgttgtggggcttaggggtccttctgaatgatcagaagcaattttgtcaacaggtggatcctgttagcttctgaatgctggtagtgctcagaagtcagaatgaagacaggcacattccatgctaggtttcttttgcatgagaacaaaacttttcttccttttatcaaccactcctcataggatgattgcttatcaaaatcgtccaacttgttgtaaagcccaaccaaatcattttttttcctctttgttgttcttgttttgtttttcatagaaatcccagtttgtgagagactaggtgctaaacttcaactctaggaagaaaatcacaaagtctacctgagcaaacatcctatggaaacccaccccaattagcaacagccagtcaggctacaatagcagagtcaaggtatatatagataatctacgagatcctgcagagattaaataatttagacatcctgctcatcaggtggtttttgttcccaagtttatttcttgcagagtacaccagaaatacagtttttaaacttgctgactcatatgaaaattcccccaagtttgctgtaaccactataaaaatcctgaaacccttgactgaggactctcactgcgacatgcttttaaagactttgatctagagcacacaataaagacccttatgtatttaaatgggaatcagctccaatatggccttttggggtctctgcaattatttaccttgtttgttgatgttgaaatttgctttgtaactttctaccaatgcctgataagacaagcctttcctagaataaacataattctgttcctaaagttttttgcctctcatatatactcagatgaagtttggccttgaaccaaaatttttaatttttgttcttcaatattagttgtattcaatttctattgtcttatatttaaaattttctatcatttttcatctgtttattttctcatttattacatcccctcatttccctcaaaccactccacgcagatctcccaataactttcctctaacccatatccatttctcctcccatttccttaaaaaaataaataaacaaataaataaataaataattttaaaacccaaataaataaaataaaataaaatttaaaaaagaggtggtttcccaagaatgtgtgagaaagatgggaccttagcataaaaagtaatagtaaggctaggaccaaaacctctcatgaaggcagaggaaaaaaaatgagcaatgtaattgcttctggctgaaataattgaaaggattctttatgacagatggtatgtttctttcttaataaatatttttaaatctcatttttagaattttctgatgagtggatttagaaccatgccaattcacaaaagatgctttctatacaataccaactaatataaagccacattaaagctgagaacgtccttttccttttagtaccctcagcaataactaagatcctatagcagtggcctgctccagtcagtaggaaataagtcataaaagcacagtgctgtgcagtgccccgcctccccatcccctggactctagcgacagaaaatacagtgaaactacaaggaccaaagttcctttaggttttcaacttcctcaggcaccaagcattgaggtgaccactgccttcattaacttactgtgactccagaaaagtgattttcttttccattttcacgatcaggattgcctcctttgaaacaagaatttgcaattactattgataattcaggatttcgtcatttgaatcatgattttggatttactactgatgatacaagtctcacctttttacaaatgctctgtaaataaagttttgcttttgtaaataaggaattgaagagttcagcttaatttcagggataacagaagtcaccagtcacttcgcttagttttaaaataattttttttcatgtacttttcagcagatacataggatgttttcttttttcttttcttgctttccatttttttttcctttcttaatgaaaatttaaaggtgattctttaaatggaatggggatgtctaacacaggacatgctttgaattctgcatttcatatatatatatatatatatatatatatatatatatataccaaaaatatatctaaataaaagtgggagacaaattttataggaaatacttgcttcagtgacataatttgtcctcaagtattatgccaattacagagtatgagagtaggtctcagttacttttagcaatttttttccattttttaattaggtatttagctcatttacatttccaatgctataccaaaagtcccccatacccacccacccccactcccctacccacccactccccctttttggccctggcgttcccctgtactggggcatataaagtttgcgtgtccaatgggcctctctttccagtgatggccaactaggccatcttttgatacatatgcagctagagtcaagagctccggggtactggttagttcataatgttgttccacatatagggttgcagatccctttagctccttgggtactttctctagctcctccattgggagccctgtgatccatccattagctgactgtgagcatccacttctgtgtttgctaggccccggcatagtctcacaagagacagctacatctgggtcctttcgataaaatcttgctagtatatgcaatggtgtcagcgtttggatgctgattatgggtacatctacacaatggagtactactcagctattaaaaagaatgaatttatgaaattcctaggcaaatggatggacctggagggcatcatcctgagtgaggtaacacattcacaaaggaactcacacaatatgtactcactgataagtggattttagcaatttttttcatttaatattcattcctcttttttagatcgtcatttaagcagtttgttatgatagcaagagaaacttcaaaatagtcttctggtggagacattttgattatacctgagtacagcagagggtcctgactattcatttacagccaaagagcaaggggatggaaaataagtattcaggaagaaagagagaaggagaaaaggtaggaggaagagaaggaggagaggactccaataatcagagacaaggaaaagctcaagaaacttgacaaaaaaaaaatattatcacaggtaaattggaaatctatgctatggaaggaggggggttgtaaaaactgaacatatacaagttagtcttctgtcaagaaaaatgacaaaagcaacaagtacacaattctttatattcccagatagtgtaccctttatccttttgattaattttaagatctatttattccacactgcttcaactctcctaaatgcccgtgttaagtaaccattgaatttggccagtgtaaggcctctacattatactaacatggtaatcagtacccagaactttatataattatccctgatagcactatcaattatagaattggaatcaaatcacagattatgacatcacagtttaatctgtatagtataataccatagactactgcacacatatcacacagattttattcttagattctattgagatggttattctctctctcaacttgatgtgatctagaatcacctgagaggcaagcctctgtcatccgtgagcagggttaacttaattcagggaggagaacctgtcctttttggaaggaccaggttaaggatccttaacactggcctcttccctaataaatttgctttctgggtcccaggcaagaactctacaacacaaaaaagagatgttgataattttgcatatatatccacaattactagttacttgtatgattaaaaactgcaattcatttttaaaaacagggattgctttaggtattttccgtgtcctaatcccacttttacacacagtgttttgatagctgcagaaaggcatggattctttttcttatttagctgaccttacttgatccttgacttttgtttctactgtataaaatcatgacaggatggccattatataaaaacctttaaacttaacctactagatggcaaataaagatgggacactgtatgtttaaagccagtctattctatacagcatcatccttgccagaaagagctattaatacaagtattttctttaaaaataataagccaggcactggcatagcctcacaagagatagctatattagggacctgtcagcaaaatcttgctaccatatgcaatagtgtctgtgtttggtggttgtttatgggatggatccctggatggggcagtctctgggtggtccttccttccatctccgagctatgccagtgcctcacaaatacagaagtcatctattgggtggaacacagggaccccaataaaggagctacagaaagtacccaaggagctaaaggggtctacagccctataggaggaacaacaatatgaactaaccagtaccctcagagctgtgtctctagttgcatatgtaacagaggatggcctattcagccatcaatggaaggagaggcccttgatctcgcaaagattatatgccccagtaaagggaaatgccagtgcctggaagtaggaatgtgtgtgttgtggatcaaagtgggggaagggtataggggactttcaggatagcatttgaaatgtaaataaagaaaatatctaataaaaacacttgaaaaaataataaatcagtcatattaataagtcttaataataagtctgtcttattattgagtattttctgccaggcatcctctgacaattttgacaaatataacactatggtgttgtagtttcactgtctctatatatgaactaatattgaaaggtatctttataattcaagatggcagaagtattctttcagcaaagtttaaatttctccagcacttgtagaaacttcagagggactgaagtagcaaaccaatataagggtgggcacccccttggctcagtatgtacaaattgagataataccatacttacctggtcattcctacattgcagcaaatttcgccacactgggattgcttctgaaaattcttccatgggatatgaagtgagatattcccatgtgcattcaaaggcaactttttatttttgtgggttacgttcttccatgatttcatattgcataatgcatatttttcaaattcaatgtatatttagcaattcctaatccattttcctttcccatgtagactttgacttgcagaaaaaaatattacttagtcactatcatatttacatttattggaaaataattgaatgtacaaacatttaaaatcggaaggctttctgcacttttggttgtactttcattttcatgttcagcaggcatgtaaatcaaaaaggcttaaagttgcatagaagagctggagtgatggtgctgcttgtaaaaacagatactgccctgcaagaggatttcccagaattcatgtcaggagtttcaaaactatgttactgaagatatggaaacataaacatcctttggaatgtacacacctctacacataggctcccacatacacactcattgcacatgcacccacacacacacaaacacacacacatacaggaatggagtgggggatggaataaacagtgactgagcaatacacagagacataaatgtagacagagagaaaaatatacacacataatgaatattaataaaatctagctcaccacggtagctcataactttacatctagcacttaatggacaaaagctgataagtttctgagttcaaagccagcctgatctataaagtgagttctgagttagcacattctaatgagtaagaccctgtccaaaaaagaaacaaagaaacaaataatacgaatctcatagcaacaattttttaaaacaggaggtaaaatttcatcactaaatgaaacaacaaattttatgtacatggtaatggtttcatttacatgaacaaacaggaaatttaaaaaatacacctaatcaagtaaaatctcattaagccagaaggttattaaggcagcattttttattccttactaatttcttctgatattatgacaattatctagtgcttctgtacatcccctagttggcgttatattttttttcctaagcaccttttctttcccttttatagagatctaaaggcaaatataaatcaatattgtatagtcaccattgcctacaaagcacctttattttattcctgactaattttcacagcagtttatgaagaccctcctctttcaaactagcaataggacagcttacagcttatggccgcctacttttgtctttagctttacagaagattttgaatccctgcagcctggcaaacatccacgcatgcgtgatgggagggctttgcaggctcactagcacagactgggggttgggagtgtgattagtcaagtcagtgcagcaggtcctgctcagagaagaggcaggcaaacatgcctctcacatccaccctaggaatggtcagcaaggcaatgcagcaaccaaggtcagctcccactttgaccccttgtttctttcatagatagatatgatttgtgcacattaagtattgcaaatttgttggggttagaacaatgttctataaatctgaagtctttagctaaagaatcatatgagaaagctatgagatcaggacctggcttcctttgtcctgtcctgtgttgtgttgtcttcagtgcccctccccttcagccttcgatatgctctgtcacatcagctcagttctcttagagggtgaacattaacatttcaaagaactgaaagtattgtgaattattggtgtatgggagggagtaagagccatcagaaaaaaatagaacattcatgttggtatgtaaatattacatacaaataatattcctaagggaaaatgattaggttctgccatggtctgagggatgggaagggatcaaagcacttgagagttaactacagattatcatcagagagaagacacaacagttaatggtagtttgtacctcccagtttctagacagatagaaggatcaggtacatatgagttttgagactatgatagttgtaatacagggaggtacattacaaagtgccttttagaaaaatagtggacagggttaattcaaagtgaactaccaatgtgtggaaatgtggagtgtctttacatacagagccatagcatacaccgtggtacagaattataaacattttttctgccatcttgtaaggtgatctattttgaatattgttacactgcttcagtgttgttaggtactagttatttattattttttgtaatcttgcccagattcaaaaataagctggtggattgtgaagtactttctttggacatttaatctatactttgtgctctaatcttctgattttgatggggtttatcagtaatggaaagtagcatgcagaatttttttgaccatactctgacagataagttcacaagatattccctgctttttgtttttgtttgtttgtgtacaggccttactggaattgtatttttctttttcatttcaaaattatgttgtatttaattttattgaagataaattttagtttcccttttttacactcctccagttccttcccacataacctaccttccacattagctctttttctgtgtttcactagaaaagcacacacaagagataacaaccaaacatatcaaaatgaaatataataagatcaaatccatcatcctagagaatggacaaggcaacccaacaaaagaaaaagtgccacaggagcagccacaagagtcagagatccacttgttgacacactcaggaatgccatataaatactaaactgaatgttataacatgtacaaaggacctagtgcagaatactgtgggtgctggaagacagaggttcacagagtcctgtctttgttttctctcattgtgttttgtttttcatttcaaaatgttaggatttaagattggtaaggtatttccaaagtggaatcacgtggtgactcatgccaatagcactctgaggttgttgcttctccaccaatgtcccctgggagtaaaccaccaatcaacgaaaacacatggtgggactcatatctctagctgcatatgtagcagaggatggcctagtcggccatcaatgggaggagaagcccttggtcttgtgaaggtttttccagtacaggggactgccagggccaggaagcatgagtgggtgggttgggaaacaggggtagacggtagggggtaggcgattttcagagaagaaactgggaaaggggataaaatttgaaatgtaaataaaatatctaataaaaattcatgcagttatagaacagtaagtaccataccatataccttttgttactttaactctgtagcataaatttaaatgtggtttggtgatatctcttgtaaatcttttattatttaaatattctctagagtgagatttttgtttccatataaagttacatttttaagattaatttgggtgaagtatattgttgattcttatactgaatatgagtaattattcatggtttccaggagtctttgactaattccctactgaattaatccttatatgtcactaaagtatttttaataactcatatcttcttggagtagtatttgcactaaattagatatttctgtttgaagtactgtcagtatatatgtatacacatataattaaatatttatattatatgcaaaaataataaacattatatatagtatttatatgtataacatgtaaattttatcaatatcatataaaatataataaatataatttataataaagtagatacttaactgcaaaatataccctagcaaaacacctagccccataccttatagaacatgtagcttccagttctcttgctatattattttatataacatatgcaacaatattcttactattgtcttagagagtataatctggtatataagttcccaaataaattctctatgtatattcacttttgctacactttgctgtggactctgatttttccaaaccctatcataccactatcaacataaaacttctgcctccagaaatcccctttctactttcatttactaagtattatacgcctgcttctctgaaaatgcatttctctatgccgatggctaatttccaatattgtatttttcacatggcttccataaaaccacacaaaacaaaagaccttacataggtgcctcatatggagagaacaaggagcaatggtctttttcagatttaattgatattactcactgctacttgatattttcgtttccacccatctatctggaaatttcatttttttttctgttgaacattttttcaatgtatgttttttttttaaagaaagcattatggtattaattactcacatgtgaatgtgtgtgtataaagcatgtaccaacagcatctatgcaaactcataggacaaactcttgtttcccactgtttgttttctaagatatacacatttacttaggatcctttatggaggaactagtggggagagagaaggagaggaagaaggagagggatcttatttctttttttttaatattattttttaatttaatttttacacttagtatttcacttcctgacccccaaacacactccaactgttcgacatcccgcatctcttccccttcccaccccatctccatgtagatatcccacccaccaccccacctgacctctaaactccgcggggcctccagtctcttgggggttaggtgcatcatctctgaatgaacacagagccagaagtcctcttctgtatgtgtgctggggccctcatatcagctggtgtaggctgtctgtttggtggcccagtgtttaagagatcttgggggtccagattaattgagactgctggtcttcctaaaggatcgcccttcacctcaacttctttcagccttccctaattcaacaacaggggtcggctgcttctgtctatcagttgagtgcaaatatctgcatctgactcttttagctgcttgttgggtctttcaaagggtagtcatgatagatccccttttgtgagtgctcctagtgtcaggaatagtgtcaggccttgggacctcccctttaattggatcccattttgggccggtcactggaccttcttttcctcaggctcctctccatttttatccctgtaattccttcagacaggtacaattatgggtcatagatgtgactgtgggatggcaaccccatccctcacttgatgtcctgtcttcctgctggaggtgggctctataagttccctcttgggcatttcatctaaagcccctccctttgagtcctgagattctcttacctcccaggtctctggtgcattatgggggatgcccccaacctcctatttccttaggatttctgtttacattctttctgctggtcctcggggcttcagtccttttccctcacccaataccagatcaggttctccactctgccccactccccccacatcccatccacttttcctctaagatccttcctccctcccaacttgtgattgctttcttctctctcccaagtgggactgaggcatcctcacttgggcatgtcacttggttcctaagctgtggatttgtttggtatggtttcgatggtgtagccttgctggtgtaaatacatttcatgcagtggtttctaagattaaaagtcttgtgaatttaagttcatcaacacaaagatattataaatgttccagaaaatgtaaacactaacaatgctccctatttaagcattcattatatacatatatgttcacattatggttccatcacatatgtataatttgtagatgaaaacaagatctgaaatgcatggtatatactcactaatacgtggatattagccaaaaacaaacaaacaaacaaaaaactgtaaataatacccaagatacagtccaaagaaagcttgttgtgcttttttaattcttttattatgagtacataccaagcatgtgagatcttgttgatgaacttcaattcactttctaatcttgataactggtttagggtgctgaatgatcaaatctctaaatacaaccaggcagaagaaagaatagatgataaacactcattagtgaggagagagccagcacaagacttttaatcttagaatccactgcatgcaatggattttcaccagcaaggctacaccatggaaaccacaccaaacaaatccacaacttaggaaccaagtgttcaaatactagaatttgtgaggtatatttgttattcaatctatcagaactactccctggcctgtaatgcctgccaatctagttcaactactctgatattctctagaaaaatatcatggcccttgtcatcccattaaccaaactaaaggctgcaaaggccaatggcttggcaagtaatatcttcccacagcttaacttggtgcagacaataaatgaacaccacagattcttgcatagataattggctacccttaggaaaaacaaaatcatttttaaaaatctttcagtaaatactgttcccgttgtgtagtcctaactaatttgtgctgattatatagacctggctagtcgttacctcacagagattttcctctgtcttccctattctaggattaatggcattttcagtacctagcctcaatcttcatctttatcttcggcattatttggcatatacgtcttctaaaacttgtgatggaagcttcaaaattttctattaggttaggaatacagatactggctttttgataacattgccccccaagacacaatgcaggataagatgcaatgggcaagtgagcttcctggtttgctcaaatgccatgggtttaaccacagaaggataatctgcaggactttgtctttggattgtttctcactgctgctgtgtcttctcatgcttttcattgttgcatttttcatatatttagtgtggtgtgattggactagggagaccctcattgcctatagtttgctgtgattgcctcttgggagagatcccattgcattggacaatgtttctgtagatcaatgtgaaggtgaaatttcagaaaataatattgtgtggataaacttatgattttaaagaattaatggttcaatttaagtatatttgaagaattagtgtagtttatagaaagtttaagtctatggtttaatgtatgttcccagaaagatgtaaaaaacttagaattaagagcagattatgtctcattccttgtaggacagttagggctacataggttagaaaagaagtacagtgaactttcatttgctgcaagcatgtaattgtagttcgaagcaaatgatagccttggggattagttagtgattaaataaagaaaaagaaaaaagaaaaagaaaaaaaaaagaaacaacatatcatttcacgaatactttcccctatggatgtaactacaggatttgaggtgaactatgaaagactgggttataagtaaagagaaaatagttgtgttatatgaaaagagagtagatgattattcagattagctgaataagacatgtgataaatgactatttatttcttggtgaatacatattgtcatcatatagatacagaaaaaaaacttgctatcgactggtttgcttaaactttgataatcagtgagaaaagacatattgctttggagttaagatgaaattgtggaaggaagtgccagcccagtaattcaatccttactcaagtgaacttagtaataaattactgaatcttcagccttcaggtttgcctgtagtgtcaatggtactcttcaagacattcacttactcaaatctcacactgctgcagaaataaacactgaaaaggattttgtctgccttggaaagtccctggagctctattggttgtttttgaatttcatgaagttaagtcctgtgctagtctaagccctttaatttttcttcctccactgactggtctcagaaggctatgccaagtcacatgtgaccctctaggtttgctttgaaagtttcaagaaacctgatagctagctcatcatcaaccaccctgctgtcacttgacactgtgacagtgataagctggtgctgctgcagttggggttcccccttcatcctcagtgagcttcagcactgggtggaatttcccaacttccaagattcaggactgaggcaggttaatcactgcagtgaactcattgatgccaaatatccacaagttggaaatactaaaagatcctccttggtactcctccggcatcaattttccatctcttgctttcttcaacagaaccttaacagagtcagcgatcttctatatgcccttagcggctgcatcttttatgattggtgtaattaaacctttatctgtagccacagcaattgaaatgtcaacagaaggcagctgtttggtccttctccattccaggtgacattaaacccaggcatttgtttaacagtaacagctactgctctgatgataaagtcatttactgagactttaatgtcatttttgaccagatcgcatctaacctttaaaactgctccaagttcatggtcagcagtagcataggcatgaggcacagtacttttgattcagttaacctcttagtgataacttttagaatatttctatcaggaatttcagtgaatgtacccactgcattaggttgcccagcgatggatactggtgggattgttgcccaagggtaagatggcccagctgtagcctgaggaagaacaaatgctgagagagaggacagaggagctgaggttggtctaaattcagtaatcttgcccaactgtttcagctcgactaacttgagtgcaccttctttaatgaggattccacgagggctgtgccctggctggcgtccaatgaatgttttttccagaatgttgcggggcagctggacttaagcagaactgtggtgtccctttgtgttccttcctgtcagggctaggaatctgtggctgtggagggggttgacaggttttgaaactggaggtggagcactggtatgtttgggaacgctcacatttccaatcttccccttctttaaccatcaaagcaatgatgtgaacccagctgtatatttttagcaccttcctcaaccactatcttgggtaagatgccatcgttgtttgcatcttagatgaccatggccttgtctgtctcaatttcacataatgagtctcaagaattcacagcttcgccttcctttttcagccatttcataatgttcctttgttccattgtaggagacagtgatggcattaggaccttaataggatctgcctgcagtagctgagtaccgtgaaaccatctccaacttgctccacggccgacaggccaagcagaagcaccctgagccagtcccaggctttgacagctgctgaagcccagaaggtaaggtagcagcgccagattatagcaaagcctccaggaggccgccatcttcccagccttctctgggaaagcttggaactcaactaaatctttggcctcaaggcccgcccaggcccctattctaatgaagatattttaacatcttactttccaatctgtgtcacatttttctccttcactcttttttttgcactaagattcctaataatataataagagggaggagtaaacatccttgccttgttccaaaaggttatcattaatatttatcactatttatacaatgctgacccttaccttcttatgtattttctctctcaagtcaaaatatgttctctgtatccttaccagtgaccacatctctaaagaaaagtgacacttgctcacccagcagccatcaatgctaatgcccccctggtatatgaccaaactatagatgaggacacatttaatgtacttggaggttttagtggtttttcatttatgtattgactagcactaaaggaaatatgaatcatgtataaccaaaccccgagaacggcacaaatcactggatataatcagaaatatctttgtgtgtgtgtgtgtgtgtgtgtgtgtgtgtgtgtgaaaatgaccatttagaatagcatcaaatcattttatgctaggacctacaacctccattgtcatgtgttttaaatatgtttgcagtgcaatgcctgatttttcaccctgtgaagaaagcctcaattgcaataaagaaagtggttgtgtagttctataaacaatagactctcataaacaatttgcctcttttgtcattattgcagcctgcaatgtccaacaagagataaaaaacatcattatcttttgctaacaatctcaataacactgtcttgtagtagtaaagttagctaaaagaatctatttttctggttagttcaagcttggtatttttcatacggtgagcacagaaatatgtgacacgttcaacaatgtggtcttttcattttttatggggaacagaaaataattacactagcctattattattagatgccttttcatttctatgactaataaatcctacaaagtaatctatgtttttcaataaaatttatattttataacaaatagagtcttgatcttcactctgattcattgcatcaggatcattgtccgcagaaatgatccatgacaatctgtgcaatcttgattgcttatgaatctaacatttggattacagatttgtcactagtagtattaaatacacgagttaaaaaaaaatcttcattttgttggaaaagggtttattttatctgaaaattctcaaatcacacaccatcactgagtgaagacaaggcatttactcaaggtaggaaatggagacagggacttaggcagaagctgtaactgctgcttaccaatttgcttcctgtggcttgctaagaatgattccttatacacagcaagattacctgaccaggtgtggtaccacacaaagtgggctggtcctcagacatcaatcatcaatcaagaaaatgactcatagacttgtatacaggcaaacagagttcaattgagattctttatttccagataactcagcttgagacaaggtaacaaaaattagcaagaaaaatatggacatgtaatgtacataacacatattttatgtattacagaatttatctacataagtgagatacatttttgatcagtgaatcagaattcaaagtccagaaacaaaggaaaattcaatgaacagttgattttacacacaaaactcacaacaaactaatttttctaacttttattaaatatactaatacatatttatttataaacctttcaagatgccaaattaaaattattttaatgcacttttaaaacacaagaagaatatacatctctctttaggttaaggaagtaaaatgcctgtctagtgtgctggagttcctgagttaaaaccccagtgtttcaatgaaaaataaatttgaggcaacagtgaatgggtagagaaggtgaaatgaactccagtcaaatcacataaccaaagtttcatacaggaaagcatcatggcaaaagtagagaactgacttcctcatgttttcctctcaccaaaaagttgcatactccaaaaagtagattcacttcattttaatgttttaagaggaatgaacatgaaatctatatttgttttttaattactaatttttgaaaatagaacttttcagaccatatattctaattgtgtgccactccattttttcctacctgattcttgacacctccataaccacctaaatcttcatgttctctctcccatttagaaaacatacaggcaaacaaacaaacaaacaaaaaaagctaaccaacataaaacaaaaccaatatccaaaggaatcagaaaaaaattcacaagaagcacattcatacagagagacatatgtccacatttaaaaacaaattaaaatacaaaatttaaagtcataatgtatgaaaaaatcaccagtatggtgaaaagcacagtacattatgaatcaacaataataatcccaaattattgttgattccatgaaatgtctgtatactacatggaatgaggattctgtatcttcatgtggattctgcacccagtaaggtacttctatagtgaactacttttttcatttggagaatttgtcaaatggagacacctccttagtgaggggtaggaggtcatattttatttctgttctcagtgcatcgacccccaaataactttgaccagtacagattctgttcatgtttcattctctgtaggagttcataagtgcatcagccctattatgtctgacaggcattattgccttcctagcattgttccaagcaccactggctttagtatcttaagatgcgtagtatcttagtattgttcttagtatcttagtacaatgtcttttacaaattttgctgagtcatgaaggaggagtttgtatggcaataagtgatttgtgattgggtcagtcaaggtcttttactctgcacattgtccagttatgggtctatgtacctggcctcatctaatgtatatattagcttctatgatgaaggtgcaacagtataatgaactatgggtataacagaatgttcttattggcccatatcataagcagacaatggtacctgtttttaccctattctcaggtattttgccatgagaaccaagtcaccgagtagtcctctaatccattcagatagtaatttcctggaatgggccactattacagcagtgtatcatgtaggcagctgcactgtctttggtagatccattagtatagaactgggttggtgtttaaatttcccctctggaatcatgcagaatgcttttcagtaccaccaacactattcaataggagaaggctttgttaagcatctgtttatcttctctatgtttaatagaaatgtaggtgtaatctgtaatagagccatcattggtttatgtagagcaatcaacagcttaggcaagagtctgagttgtgtgtgtgtgtgggtggaggagtactgggtatcttgctatgagttttttctgctgcattaaactatgagttctattatctttgtaacagctgagcaatattccattgtgcagtgtaccacatttcattaacatttccccaattatggggacatttctcttctttccttctaatatgaatatgcctgcaatgaataggaatgagtaagtgtctctatagtaggatatggactcctgttttggatatatgccccaaaataatacacctggatcttgagtaacaacattcccagtttccaaatgaaaaatcacactaacttccaaaagctgaactactgtgtatttcgacctgcagaggataaggactgctatgatcatcctccctagcatgtatggtcatttgttttattgatcttgcccatactacgttcttgaagattaaatctcaatttgctttgaatatccatatagatgaataatgagaatgttgaacttttcttttagtgaaaccaacatctgaataatggtcaattatgggtcattagaggaagggatttatatttaaatacaaaatgataagtaggggaaagccatggaaattagatgtacagaagacattagtattaagagaaaaatcatagcaagtaagacaaccaacacctttgacatatttcagacaattatattgagcaatttcacttcctgtgtgtgtgtgtgtgtgtgtgtgtgtgtgtacaaattggttctttaatatcataagagaggccagggagttgataaacaaaatgttgttactgaatttaagaaacatcaagttcataagtcaaggattagaaactatgaagctctaagaatcatgggcaaattttttgatagggaaaatcaaaacagtgtgataggaaaatcaaagagcctacagcaaaggaaattgccattaaaaatgtattctcagggcagaaactctttagttctcctatatctcagccacagaattcattcttgcctttaataacacaagccaagtgatgcttgaaggagtgattacctctgtgttcacagtgtcatttatcttttgataaacaagtagattgatggaaaacactacaaaaagtttttagtagaatgaagatggatagagactatgaaatgactgtgctcttttcaatggatttaagcagtcatctcaaagccaaatcctatccctggtataagggatatctaaggtatgttccacttcagagacataggaagcataatgcaggatcctgtaagctggcacatcacattatattcaatgtaacccaatagttaaagatcaatgagaatcctgtgaggctgactgagttttaaaaaatgggtggagagaaatatttgccaagagaatatacaacatgcagatttaaaagagaaattgatttattaaactattgtatatacttatacttcatcctgtataggtgcattttcttccacatattatttcagttacaatacaattaatataacaaaaaggactttattaatcaaagtgttgaagctctttacaatatcacttcactgtgagagttgccacatttactttcctcagccaccatggaggaggcagtacttctggcaacagtagttgcatttatctccttcactgatgctcactaccacttctggatttacacaagagatgtactctttttcattagggctgagaaaatagctctgtactggggtgttgtaggaggttaggggtccctctgaatgataagaagcagttgtgtcagcagatggatcctgttagcttctgaatgctggtagtgctcagaaatcagcatgaagacaggcacattccaccttagggttcttttgcatacaggactaaacttttcctccttacatcaactacttctcttaggatgattgcttatcaaacttgtcaacatgttgtaaagcccaaccaattctgttttttgttgttgttggtggtggtggtagtggttttgttttgtttgttttgttttgttttgttttgtttgttttattgtacaaatcacattttgagagacctggtactaagctgcaactccaaaaagaaaatcacaaagtccacctgagcaaatatcctatggaaacccacccctcttagctaatgacaatcaggttgcaatagcagagtggaggtacatatagataacctaagacatcctgcagagaatagataacttagacattatactcattaggtggttttatccccatgtttcattcctttatgtacaccagaaatacagttttaaagcttgctgacccatatggaaattccccaagtttactgtaaccataataaaatcgcaaacacccttgacttggggttctcactctgacatgctctgacagaaattgagggagaccccgatctagagctctgtaaggtgggcataacactgtaacccaccacttcaaagggtctctttcccttgcttgtcgatgttgaactctgctttgtaactttctaccaacagctgataagagatgcctttccacgaataaacataattccgttcctaaagtgtgttttccctctcatagttactcacacggccttgaaacaatttttttttaattcttgttcttcagtatcgtattcgatttctattgtcttacatttaagattttcctatcatttttcatctttattttctcataaattacatctcatttcccttaaaccactctacccagatctccccaatatctttcctctcacccatacctactcctcctcccattcccttaaaaaaaacaaagaaagaagaaagagagagagagagggagagagagagagagagagagagagagagagagagagagagagagagaggtgatttcccaaggatgtgtaaggagaatatctgaccttagcataaaaacttacagtaaggctaggaccaaaacctctcatgaaggcttggtgaagaaaccatcagctatttaatttgttaacaaatatttttaaatctcagttttagaattttctgaggagtggatttagaaccacgccaatttgcataagatttctacacaataccgactagaataaacccacattaaagctaagaatgtccttttccttttagtaccttcaacaataactaagatcctatagcagcgtcctgctccagtcagtagacgtgctacaggaaataagtcataaaagtgcaatgctgcgtagtgcctcgcctccctggtcccctggactctggcagcagaaaatacagtgaaactacaaggaccaaagttcctttaacttccccaggcgccaagcattgaggtgacctctgccttcattaacttactgtgattccagaaaagtgatttcaactttcactggtgccaagtaaagaagtgacacctgccttcattaatttactgtggttgcaggaacacatcactgtggtttgcttttcctgtttttatgttcaggattttgtagtttgaatcatgattttgaatttactactcatagcacaagtcccatttattttttaatctccttttcttcagatatagatttacaaatgctctgaaaagaaagttttgcttttgtaaataaggaagtgaagcgttcagctttatttcaggaattacatgactctgaattttgaaagagtttgatatatcaacactgtgggcctttgtaagtccaggacagatgtttgatattcaacctttagaaatgtacttttctaacataaacaaatgtgagttttatcttcatcccaaatataagttagattgtaaacacagtggattacagcatgcaagaggtaaaagcagagaaaagacaatatatactctgtgccattatatgctggaaatacataacttgcttttgattttatgggtattatattgaaagtattgacttgaggctcagaagacaccttcatctattaaacaatattcattttatgaaagatgatggggtctttaaagttgtataataaatatttttattatgatatgtttgtgagactgtgagagacaaagtgtagagtgcagtgatttgaatgagatgccaactattagtctccaatttacaaacttttgattacaagttgatgactatttgaagaagattaggaaatgcagcattgctggacaaaggatatccctgggaatatttatttttcaaaaatctcttgatgtgtcaaatatgtctctctgcttcctcactgtagtctgagatataagttgctaattcagcaaccttctgcttggcagtcaagatacagaaagactgaaaataatcttttgctactacaattttattttattaatatatacttgttgttgttactaaaggattcccaaatgtaatcctgtctttattaaattcaatgcagattctctgtctgtgtctctaaagtattagacttaaaggcatgtgccaacatgactgttcttttatcacaaaagtatttaattgtaaaataattaatattcaaagacagatgcacatttcaaaatgaaatagaaagcattcagtatatagactcacatgttcaattacatcattcaagagatggaagcaaaagaattactacaagtttgaggccactctaggctatagaatgaggcaccatctcataattttcaaaaataaaaaagggtaggaacaaaagaagtcaagtaaaagagaagaaggaggaggaagaagaggaggagaagtagtagtaggagaaacaaaggaggaaaaagggaagaggaggaggaagagtaggaataggacaaggagaaaaggactcccataatcaaagacagtgaaaagatcaagaaacttgagaaaaatgattaatacagatgaattagaatttagtgctatggaaaaggtgggagttagaaaaactgagcatatacaaattagtcttctgtcaagaaaagtgacaaaaacattaagtacacaattctttatattcccagatagtgtaccctgtatcctttctttaattaaacaacaaattttatgttcatggtaatggttacatgtacatgaactcataggaaatttaaaaaaaaaaaaaaaaaaaaacacctaatcaagtaaaacctcattaagtcagaattttgttaaagtaacatttttacctcttagtaatttcttgtgatattacaacaattacctagcaattttgtacattctctggtttgggttacatttgtcctaagcactcttaatgtcttttgcatagagttctaaaggggactataagcattgtgtagccaccaatgcccacatagcaccttcattttattccttaacaatttttacaggggtttatgaagacactcctctttcatactagcaataggacagcttgcagctcatggctatctgcttttgtcattagctttaaaaaagatttgaatgcctgcagcctggcaaacatccacgcatgcgtgattggaaggctgtgcaggctctctaaaacaggctgggggttgggagtgtgatttgtcaagtcagtgcagcaggtcctgctcagagaagaggcagccaaagatgcctgtcacatccaccctaggaaaggccaggaaggcaatacagcaaacaaagtcagctcccactttgactccttgtttctttcgtaggtagacatgatttgtgcacattaagtattgcaaatttgttgggattagaacattgttctataaatctcaatctttgactctgaagaatcagaacagaaagctatgagatcaggacctagtttccattgtcctgtcctgtgttgtgtctgctgcagtgcccctccccttaagtcttcagtttgtcctgccacttcaggttgaacattaacaagttgacagtattgtggattattggtgtgaggaactaagagccatcataaaaaaaaaaaagaatgtttatattggtatatgaatgttacataaaaataatatgcctaagggaatttaaattaggttctgtcaagctttgaaagatgggaagggataaataaaatgaagatttacatacagattatttttagagggaaggtacaacagataatgatgggtttcacttcccagtttctgaatgagtaggaggatcaggtacataagagtttcggcactatgatagccataatacagaaagggagattccaaagttcctttgagaaaaaaatagtggacagagttaattcaggtgtgtgaactgccaacgtgtggaaatgtaggatgtctttagataaagagctgtaacataaacagaggtacagaattataaaccttttttctttcaacttgtaaggtgatctattttgaatattgttaaactacttcattgtcattaggaactagttattttttaattattttttaatcttgcccagattcaaaaataaactggtgaattgcgaagtactttctttgggcatttaatttatactttgtgctctaatctcctgattttgattggatttatctgttatgcaaagtagcatgcagaatctttttcatcatactctgacagataaattcacaagagtgtgtcttggtttttgtttttgtttgttagtttacaggacttattggaattgtattttttttatttaaaaatggtattgtatttaattttatagaaaattaatatcaatacagtattattattattaaactttcttttttctactactcccagttccttctcatataccctaacttccagattagcttttttctgtctttcagtataaaaacacagacaagagataacaaccaaacacataatcccagccacttgagaggcagaggcaggcagatttctgagttcgaggccagcctgatctacaaagtgagttccagaatggccagggctacggagaaaccctgtctcaaaaaacaaaaaacaaaaacaaaacaaaaacaaacaaaacaaacaaacaaacaaaacatcaaaataaaatataataagagcaaatccatcatattgagagtagacaaggcaacccaacagaaggaaaagtgccacaggagtagggacaagaatcagagacctacttgttaacccactcaggaatgccataaaaacactaaaatgtatgttataacatatgtacataggacccagtgcagactattgcagtctctgtaagagagaggtccacagagtcatgtcctttgttttctctcattgtattttgtttttcatttgaaaatgttgtttggatttaagactggtaaggtatttccaaagtggaatcatgtggtggttcatgccaacagcaccctaaggttgttgttactcaagcagtgttaattaatgcagttatcaaaaagtacgcaccataccatataccttttgtttcttgaacactgaggcataaatttaaatctggtatggtgatatctcttgcaactcttttattatttaaatttttttctacagtgagacttgtttccatataaagttacattttttaagattaatttaggtgaagtatattgttaattcttacattgcatatctataattatttatggtttctgggattcttagacttatattccttagtagattaatacttgtatgttactaagatttttttaataactcatatattcatgaagtagtagttacattaaattagatatttctggtggaactactatctatctatctatctatctatctatacacaatattaaatctttatattataggtaaaaataataaatattttatacatacagtatttatatgcatataacatgaaaattttatgattatcatatacaatataacataataattcataaaaaattagatacttaagtacaaaatatagcctagctatacttttttggagtatggagatatgtatataatatgagtatgtgtgcacaaagacaaagctttgtacatatatatatatatgtatatatatatatatatatatacatacatatatatatacacatacaacttatatataatatatgaagtacactttgtgtatatattatagatataaaatatagtttatagagacagatatatatatgtatatatgtaaatatacatataattatatcaatatctccacattctcatcaagtacagctatattttattattatatatttagtatattaagtattatgttacatattatactacatattttaattataaaaatttattttatgtgcatttatacatgtaaataaatatatagctataataaagttcttatgtaattcatataacataaatatatacatatatatgtataggtttcttaaagattttttatacatcctcagttttgcttaatgcaatgcacttattctacccaactttaacacctgttccaaatcctgatagaacatatagcttccagtatgctttctgtattattttacatcacattacttactattgtgttaaatagtataagctattatataagttcccaaataatctctatatgtacatttcactttggataaaccttgctgtggactctgatttttccaaaccctatcataccactgtctacataaaacttttgcctccagaaacctcccttttactttcctttaccaagcattatactcctactcctctctgaatgcatttttctatgccaatgactaaattccagtatcatatttttcacatagcctccataaaacctcacaaaacaaaagaccttatgtaggcactgcatgtggacagaacaagcagcactggtctttttcagatttgattgacatcattcactgttcctggctcttatcatttccatctatctatatgtaaacgtcatttgttggtattaaacattatttaactgtgtatggacacaatgtatttctttaaaataaatatatgaaaaacattttcatattaattattcacttgtgtgtgtgtgtatgcttgtctatcgtaccaacaacacctatacaaagtcagagggaaaacctacacaagtcccttttctcctactctttgttttcttagctctatacatttactcggggacatttaaggagaaaaaggagggatatcttattttcatgttcaaactattcatatatgtgaacatatacatgtgtgttatctagggagcattgttagcatttgcattttctgaaacaatatctttatgttgatgaacttcaatgtatccctcagatgatcactggaataggatgctgaaagatcaaatatctaaatacaatcagaaaatgattagatcaaagagagctaggacaagacttttaatcttaaaactgatttcctgtgttgtgcttcagcaaggcctacaccaccgaaaccacaccaaacaaatcaaccacttaggaaccaaatactagaatctgtgagatagcccacaacatgggtcaattttcctgagttaggtagttttcctgtagatctatgtgatggtcaacttccataaaataatattgtgtagatgaacttatgattttaataatgcatttttgattaaaatagttttaaaagttagagtagaatatagaaagtttaagaagatggcttaagttgtgttgccagaaagatataataaagttagaattaagagcagattgtgctccattccttatagaatacttaggactgcataggttagaaaagtgtacagtgagctcttatttgttgaaagcatataattgtacttggaagacaaaaattgccttggaagtagtttaggattctataaaatgcacaatatagttctttcaataattaatgtctgaatcttcatcatgatatttttcaataagtattattctgtatatttcaaacttatttatattatttcagacaggaggattttttttattcctttagaatcatggaatgatagggaggatcatgaattacacggataggcagtagagaagatttagaaatttggtagaaaagcatcaaaatatattgtatgacaaacaaacatgtttaacaaggatgatgtcactggaagagccaaacccatgcagataacctcataaagcctcaaccttatacaaaatgttataagtatatgtaaggagttgggcatgtgagaggtggactttgccagggataagtatgttaattggtggatcaatgccaaatgttcaccactgaaaacatagacatgtaacattatacagactgaacaggttattaacaagaaaactcatggatatatgtgtgtgtgtgtacataaatatatgcatacagtaatttggttgtgggaaagtatcattaatttaatagactagagggtgatgaaggaatattttgagagagggaatggcaaatgtatttatttcatgaactaaaaacatattaaaattatatactttacataaaaatatgtcattgtttgaactcatggaagatggatcagctgtagaaggggcatgctgccaagtcagaaaatttgaattcaatctctgagatccatttgatgaaaagagaaaaatgcttaatttaagtaatacttaacactttaacatgtggacttgaaatttgtgtgtgcatgtacatgtgtgtgcttaaccatgtgtgtttctgtgtgtgtgtattttatatatatatatatatatatatatatatatatatatatataaaattatagtgcaattatattaaataaataagctgcatttttttattttttattaaatattttctttatttacatttcaaatgttacccctttcctagtttcccctcagaaaaccccctatcccttccccctccccttgctctccaacccactcactcccattcctggtcctggcattcccctatactgagacatagaaccttcacaggacctaaggcctctaatttgatttttttcaaactttgtgggtttgggttcatttattatgcataatatcatcttcaaatagtatatttaaaattattttaaaactgagccaggcatggtggcacatgcctttaatcccagcacttgggaggcagaggcaggctgatttctgagttcgaggccagcctagtctacaaagtgagttccaggacagccagggctacacagagaaaccctgcctcaaaacacaaacaaacaaacaaacaaacaacaacaacaaaatcaaaacaaacaaaaaaatgagacaccaaccaggcagcacacactagctgatatgaggccaccgacacatacagcagaagaggactgcctggtcctaactaaccctcaagagacttgagaccccagggagtggggagatctggtggattgggggcatgagggaatcattcttggagaagaggaggaggaatgggttgaggaaatgttggaggacgactaggagggggataacagctggattgttaaaaaaaaaaaacgtaaagaacaataagaagaaatgtattttgattttagatggttggtttgggtttcaaaacaggatttatctgtatagacctggctgttaggtttttgctctgtagatcagcctgttatcaaactcaataagattcatgttcatttcccttgtaagctctgtgattaaaggaaagtgcaaccacaccaggctgaaactgtatttagcctgcaaaatctctctctctctctctctctctctctctctctctctctctctctctctctctctctctctcacacacacacacacacacacacacacagacacacagacacacacagacacacacagacacacagacacacacactgggataatgtggatctatgtttttacacacacactcacacacacacacacacacacacacacggaaacagaagctagactagaatttactttgtacaaacatgactttgacctcatgatccccctgccaacaccacttgaatccaagtacaagaggtgtttaccactattctgtgagtatagataaccatttattttgggggggggcatactaggtaagaagtgtaaaatctatacaatgtcattgcactggttatataaatcacacttaggattgcaccccaatggccaataacaacatattgtacaaacaaatacatatgtgtgtttgtacaaaataatgtacattagcatatatatgtataataatttttttaatattagagggttggtttggtttttcaaacagtatttatctgtatagaaccagctgtccaagatcttgctctatagaccagcctagtctcaaactggctactctcaaattatacacacacacacagacacacacacaatttatatgcacctaaatatattagttactttcacccatctctgctttaattcaaaagatcaagaaaaaaactctacatttcatttttacatctcaaacttttttcaccttctgagaacacacccatatcttcagcatagctaaataacactcatgttcaactacaaatagtaggcctttcgagattcttctgttaagaattatctgcttagctatgtgccccattttttaaactgggtgatgtgctcatttgtgtttaacttcttgttttctttaataaattttggatattagtcctctgtaagatgtggggttggtaaagatcctttcacaattcctagtctcctgtttagttttattgatagtgttcttggccttacacaagctttgcagtttcatgaagtcccattttcaatgttgaccctggacattggagtactcttaagtaaattgtttcctgcaacaatgtgttcaaggttatttttagtttatcttgttttatgttgatgtccttgatccaattggacttgaattttgtgcaggatgatggatatggaactatttcactcttttacagtactcctcagttatactagcaccatttgttgaaggtttttttttttttttttggttattttgttgaaaatcaaatgttcctcagtatggggggttatttctggagtttttattctattttattgataggtgtgtctgttgtcgtacaaataccatgtaaattttaatcactattgctctgtaggacaggttgatgtcaggaaaggtgattgtttctgaagttatcttattgataaagattgttttggatatcctgggtttattgtttttccatgtgaagttgaaaatcattgctagagatttttatatatgtgtttagtgtactggttcattttacagaaacctctctccaagtatttctttcttataagccaacatgtttcaagtaaatacttaaatctccacttacattttatagttttatttctatagatgataaatttactaatttttatatttctatgatattaaatgtcctgttcaaaagttctatcttatgttaacgatttgaaattactcactacttactcctctattagattcaaggcatcatgtcttaggttacagtccttgattaatttgcagttgagttttggagggcaatcaataaagatctactttcacttgcctatctgtagctatccagattgatcagaacagtttagtgaaaaaaaatttttaatttttttcaacaaacaggtggctgtatcagtgtgggattatatgtaagttctcatttatattcaattgatcagtgttttaagttttacgtcatattgtgcagacttttgtcacttcagctgtgtagcacaatgtgaaaactggaattctgataattccttctgctttgttatacagggtttcttgttttggttttggctttgttgtggtggtggttgttttgtgttatattttctgtttgtttgtttttaatttgtttttttttttttttgccaaagtgaaacttcttgttcctatatgaaattacaattacatctctctctctctctctctctctctctctctctctctctctctctctctctctctgtctcagtcttttgagacagggtttctctgtgtagcctggctgtcctggaactcagtctgtagaccagactggcctcgaactaagaaatccacctgcctctgcctccagagtgctgggattagtggtgtgcaccaccactggctacaattacatttctaattgtgtataaaatgttttgttttagattgcattgaatgtgtgaattgcttatggaagaacagccatttgtaaatagctctgttattcctaagaatggaggccctttaggctttagtttcttcttcagtaaacttttctagtttcttaaattatcagtattgccttttgcattttagttgtgtgtgtgcatgtgtgtgaattgtgaatagcattgttttatgatttcttaaatattaactggattgtatatgaaacctatttaattatgtgtgttaaatttttatcctgtcacctttgctgggtgtatcagttgcaagaggtatctggttgaaaattaaggacactatattcaaatgaataggcacatcatattcaaatgaagaatctttaaactctgactttacaatctgtcatatttttctccttcacttttttgcactaagactcctaataatatagtaagtagaagagtagggtaaaaatccttgtcttgttccaaaacattatcattaatatttatcatcatttataccattctggttttaccttattatgtattgtctctcttacatcaaaatatgttcttagtatccttaccagtagccacatttataaagaaaagtgacacttgctcatccagcagacatcaatgctaatgccccccaggtataaaaccaaactatagatgagtacacattaattgtacttggaggttttttttgtttttcatttatgtactgaccaacactaaatgtaatatgaattatgcataaccaatccctaggaacagcacaaattgctggatataatcaaaaatactttttttgtgtgtgtgaaaatgaccatttagaatagcatgaagttattttattctaggacctaaactccccttgtcatgtgtcttaactgtttcccgtgtcatgcctgattttcatcctttgaagaaagcctcatttgcaataaagaaagtgcttacccagtgctataaacagtttcagcactactgcagcattggtacattttgcctttcttgtcattattttagccttcaagatccagcaagagataaaaatcagtaacttttctgttcctgacaacctgaatagcatattcaagtactatgaaagataagtaacagaaaccattttctggttagtgcaaacttgatattgtttatatgtctggcagatgaaatatgtgattaccttcaacaatgtagtcttatcatcatatttttaaagggaatagaaaataattgcactagcctagtatctttatatgttttttggtttctatgaccaataaatcctacagatgtaatctttgtctttcaattaaatttgtatttactaacacatagagtcttgatcttcactctctgagtcattgcattcgatataaggcctagtcctcagaaagtatccacaacaatctttgtaatcttaatatcttttaagtctaacatttggattacagatttgttactagtaaaagaatcattttcattttgttagaaattggttcatttcatctttttttgttttttaaattttttaatttatttttttaattaggtattttcttcatttacatttcaaatgctatcccaaaagtcccccacaccctctcccccactcctctacccacccactcccacttcttggcattggcgtttccccgtactgaggcatataaagtttgcaagaccaaggggcctctcttcctaatgatggccgactaggccatcttctgatacatatgcagctagagtcaagagctccagggtactggttagttcatattgttgttccacctagagggttgcagacccctttagctccttgggtactttctctagctcctccattgggggccctgtgatccatccaataggtgactgtgagcatccacttctgtgtttgctaggccccggcatagcctcacaagagacagctatatcatggggtcctttcagcaaaatcttgctagtgtatgcaatggtgtcagcgtttggaggctgctaatatgtgaccaagataaatttaagaaggtcagactatactgtagaatatgagaccaggaactgaactgagctttttgggtatcgtgatctgtctcattcgaaagaaaaaactctacagcaagaggactgaggctatatatgcctcagaaacaagcataatggaagttcagtggaatggcaattccttctgtagaagatactatatttgaatattttaaatacctcatgagtttgacttttaactgtctaaaaatgaggggaaaaacagtggaaataaactgtcctcaaaagtattatccaatgttttcaactaccatctttcctttgtggcttccattgataagcaggtatctcctaagttgagcagccttggtttctgtgttggcaaagactagggttcatttcatcttaaaattctcaagtcacatactaccactgagtaaataacagtcattaactcaaggcaagaattggaggtaagcagaagccatgatgctgattaccaatttgttccttgtggcttactctgaatgcttccatatacacagcagggttgtttgaccaggtttgggaccaaacaacatgggctgggtcgtcacacagcaatcaccaattaagaaaatgatgcacagacttatacacaggcaaactgatagaaacagtataactgagattctctgttcccagataactcagcttgagacaaggtaacaaaaattaacaagaaatatatgcacaatcagcttccaaacgctgacaccattgcatacactagcaagattttgctgaaaggacccagataaagctgtctcttgtgagactatgctggggcctagcaaacgcagaagtggatgctcacagtcagctattggatggatcacatggcccccaatggagaagcaaaagaaagtaaccaaggagttaaagggatctgcaaccctataggtggaacaacaatatgaactaaccagtaacccccagagcttgtgtctctagctgcatatatatcagaagatgacctagtcagccatcagtggaagagaggcccattggtcgtgcaaactttatctgcctcagtacaggggaacgccagggccaagaagtgggagtgggagggtgggggagtgggtgggggagcatgtgggggacttttggaatagcattggaaatgtaactgaaataaatacctaataaaaaaagaaatatatgcacatatagtgtacataacagatattttatacattacaaaatttatctacataattgatatatacttttgatgagtgagtttgaattcaaagtccagaattgaggcaaaatttaatgaacaggtgatttttcaaacaaaccctatcctacgacaacttaatggttttcaactttctttctttctttttctttaaatgtactaatacacatttatttgtaaaccttttcagataactaaaattacttttaatgcactttaaaatcatagaaagaaagataatataatctataaaatacttgaactgaaggacatttgtttataacttttccattagttaaatagatatacatcgtagtttttaactctatgtgtttatgtatgaattctatgtaagtttaggtatattcattaaacagtgtacctgtgaatgtcagaagatgatctttgtgagctggttcagtttcctcaatgtagattccagatatctaatttaggtctctaagcttgtatggcaggtatttatgatgccaaggtaactcattggcttgtttccattatcagtattgcattaaatagttaaatgcacataaggctagtaccacatcatcctggtaatatatgtgcattttatggttattttcaggactatatccaacaagttaaaatgggggtcaatactttaaaactttgtgaagcatgttcaatttacttcaatatattctaatttaatctttttgaaaatcatttaacttacttgacatcttattacatatgttttactttaaaagtcccacgggctgtagaatatgggcacaagaattctacaagaacaataaatatacaagtaataattttacctattttttattttaataaaaacaggaaaaacatcttacaatattataccagggcataaaatagtcacttgagacatagcaattattttgaaatctgctgtggctcttaaatggaagaaaagaacaagttttgttgccaaactactagtagtggaaagaaaatgcactgtgaatagaagaatgtgctatcacaagagactgtgtggaagagttttttttactccaatattttgtggagcttattcaataaaatatgtatttaagaaatttcttttggtttctttcagaaaacacataggtttcattgctatttggaaagaaaaatggtgtgttttcacttattggagtgactggtattgagaaacctagtggccctcacttatccatctctcaatcacatggtgtcttagtcagggtttctattcctgcacaaacatcatgaccaagaaacaagttggggaggaacgtatttattcagcttacacttccatactgctgttcatcaccaaggaagtcaggactggaactcaagcaggtcaggaagcaggagctgatgcagaggccatgaagggatgttcttgactggcttgcttcccctggcttgctcagcctactctcttatagaaccaagactaccagcccagagatggtcccacccacaagggacctttcccccttgatcactaattgagaaaatgccttacagttggatctcatggaggcatttcctcaactgaagctccgttctctgtgataactccaactgtgtcaagttgacacaaaactagccagtatacatggcatggcatgttctcactcaattcacttctttttcccattaattaagttatttattcatgttacatctcaattgttgaccttctcctggaatactgtttacacagtccttccctgctaacctccttcctcttatattctgagtgggtggaggccatccccctaccatgacagctcaagtctatgaagacaaggtacatcctctctcactgagggcaaaaataatcccagtcgaaggcatggactccacagacaggcaacagatttagggtcatccccacttcagttattctaggacccacatgaagcatgaactccacatatgctacatatgtgcagaggacctaaaccaagcccatgtttgcattttggttggtggtcagctctaagagaccccagtatccaggttagctgattctgttcatttttctgtggatttactatccccttattggccctaaacccttcctccaactcttccacaagattaccatagctccaagcaatgtttggctatggggctctgcatctgtttctgtctcatgatgtgtggagcctctcagaggagagtcatcctagctttctgtcagcaagcacaacagaatatcattgagagtgtcaggagttggtgcttgcccattagatatgtattaagttggtcaggttattgtttggccattccctggctccctgcatttctcatagatagaatatatttcgagtcaaatgttttgtgtgtggtttggtctccttgtccctccacttacactccttcctgaacacttgaattatccccttcaggctccatatcccacaaaaaaaggaatttaaattataacacatccttatcttatctcttctgtaatttaactatctactgtcctgggtttgctactgccctgggggtgcccaggcttccttgttcagaattctagaatggaaagaatgaagcttagctgatccaggttgtttagagaggaatttggtctgcaggagtgtaagatcaatggccttctccagagatggttttcagcgaaacagcttttcgttattgggtgtaagaagagttatataaacgtttcagaagagctaggggttctggggtgggtgagtatgaatcatagctgtggttaaagtgctaggaatatttcatttgcataaagacaaattccaggtgcctgctagacctatcctcatagtgagaaatttaaacattaatttggctaccagactaagtgactacctcaagggtgatggaggtggggccttaaaacctatgttctctgggaaaaacaggcccagagcaagttggaaaacagtcctactcttactgattttcagtgacctcacacttgctccacactggctcccccaagggcatacctttctgggcctgaaaactatcctctaacatttccatactgagactaagacaaaataattgatcaaatcaaattgttagttataaaacactaacaaaactattgttacttaagaccaatctttggtaaatttggaaatgaaataaactacccaaaagaaaaatactaatcctaaaataaggataaatgattttgcataccctacaattccaatatttcctaaaatataaataactgtatatacaatgcaaataacatagtcagtgttgataagatatgtgatggggtgataatcaaagggtcaggaaattgaacgaatgtttatagcaatgagggatggagaactgtaggtagccaacagaacatcccagatgccaggaaagcaataggttcccaggacccaacagggatgacattagccaaaatacccagcaaaatggagagagagcctgtggacaccatatccataggttaggcaatgcctccagttgaggaatgggaccacccactcatctctaaatttttaacccagaattgcacgtgtctcaaggaaatatagggacaaagtgtggaacagagactgaaggaaagggcatccagtgactaccacatatgggattcaatcccatatgcagacaataaacccagacactactgatgatgctaagaagtgtttcctgacaggagcctgatatagctgtctcctaagaggctctgctagagcctgagaaatacatatgtggatgctcacaaccaaggaaccaactgagcctggtctctaacacaggagttaggtgaaggactgaatgaacagaaggggtttctaaccccataggaagaacagcaatatcaatcaaccagacctcccagagttcccagagactaaaccaccaaccaaagagtacatatggagggacacatgccccagctgcatgtgtagcagaggatggcattaatgggaggggagacccttggtcttgtgaaggcttgatgccccagtatagggtaatgctagggtggggcggtaggagtgtgagggtgggaggtactctcatagaggcaggggaagggcggaagggataggtggtttccaaaggggaaactgggaaaggtattacatttgaaatgtaaataagtaaaatgtctaattaaaaaaaaagaaaaatgaagaaaatacctaattttttaaaaaatttaaaaaaagaaaaatactaaatttaaagctaggataagtgatgttgaatgtcttacacatccaacatttcaaaaaatattaagagctatatatacaatgcaaataatatagtcattgttgataagatatgcgatggcagaagcagaggaatctgtgggtagatagggtgtttgcttctctaaattgctattgttacttctcttattcatactatggtctttagtgttataccttcatgtgtaataatactgttcaaccattgcatataaatataaagtcacatacagcagaagagagtaataatcacacctggattgggaacataattaattttgatataatactggattttcttaatgccttcaccaattaattgtataccctgaattctgtctcatattatcagcttttaagaatgtttcctagaatcatgagaaatagaacattagactgttgagtgtacaaaatgtcatttttagtcaacaggggaaactttcaacgaagctcacagaaaaaaggaaaaagatagcatctaaatgtttaagaaagttgagtgacttctaagaactttgcaatatattatatttgaaatgctaaaggcctatatccaaaatatcttgggtgtttagtgcccttattagcaacttaacgaaatatctctcaattaacatactttcaattagatggtgaaacttttggaatttattataagagcactagctaaggaacagacaagtaaaacctaatatagacctatcaccaagtgttatataaaacctaaagtaggtattttctcattttttatacccctacagtagattttcctcagaaaagtacttgtaaaaccattagtatgtgaattatattaaaatgtagctatacaagtctttgtaaatactttagtgttggaacatatactgaaatcatcctgaatctgtgttcctaaatgctgacatccatattgagctaacagtaaataatctattctttttcttttcaagtaaaatttatataccaataaaatgtgtgccaaaatacttctaaaggtctaaactctctgtattctattaaacctaattcttactatgatactataagaacttatcactttaccctttccaatttgcctatattcgccttcccactgtaattgggaaaatactaccctagtttattttattattggatatcaaaatagatataaatttcttctaaaatattaattcaatttctatatgggaaattatatcaacaattatggtgaaatcataatgtgcaaataatttaatcatttgaattagatcttcatgatttctgaattccatcatttcctctcacttctactgtaagtaaagtgtcttcataattttcataagttgtaatatgttctatattctttaaccttcatcccaaatcttccaagtaaatttttgttcatttgttttgtttctatgttaagactgattacttgctattttggatttgttttattaattattatgtacccaaaattggtgagcacctgaattctgtctgacttagtggatcatatgttagcattacaggaatatagaaaatctccacacatttacatccatagtaaaaaaataaaatatgagtattaaaagtatttgggggatatggacttaaagttagagatttttattaaaaagattatttttccacaataatataacctgattacagttgttctccctctactaatcagagtccctgctcacatgtatttctatttttacaaatcttttctaagagctaaaattaaagttaaatgaaaataagaaattgccctaacacaaagcaagtattaacaacacaatgtgaatggacaaagcaaacatgcagaaggaatagagtcccaaaaaaaaaaaccacaagaaaaggagacaactaactcacatttgcaggaattccatagaaatgctaaaatggaagacataatatatacgtagagaaacaagtgcagacactctgagagttcatatgagctcagactatattgttaaagaaagccttgttttcttggtggtcctcatgtgttatggattttacactttctttttgcctcctctttttaatggttaccttagtgctgaaatgatggatttggtggagtgaataaggttagggatgagtgtctctagaacactcactctctgtaacagtgtgggtctctgtacttgttcccaactcatgaagaagccctaaagttaaatgagatgttagttgtttactcccacatgctttctttcaccattgcagtagcatatctttcaggcaagatactattgtaaatcaaatgatttatggcttgcttattgtgtatattcctatttcagtagcgtgtagacttcattcttgaaccaaggacagtagaacatgattggagggtgaggtgtgggctctaagtaggtacgagctcaacatctcatttttccatgagtttagtaagtgtaacccactcttcttactggaaagatcatttggtaacagagttatccgtttctacctctaactttcatattatgtggcaattccatttaatatacattcatatatgcatatattcatgaagggtctactgtttatttccatactaatcctcaaagggtccttatttttaactgtgtatccccatattccctcctctactcacttctccatttcactccttgttgttcctcttccaatccccattctgcctatccatatcaaattatttaatttccctgtcctatggagacctatctgtcactcctagtgccttactctaaacccaatctgttttttccagattagagtttgtttatcactgacttaatagcaattgtccacatataagccaactacatatcacatttatcttttggggtccggttttcatcattcagtatgataattcctagttcagttcatttaccagtcaatttcattaattcacttcttttaaagtatgagttttatggagcagtgatctttgtgatattgtggattttctttagggtatatgccagttgatctgggtcttcaggtagaactattttcaattttctaaggaaccaccagatttattttgagagtgtttgtaccagtttgcaatctcaacactcatgaaagagtgtctcagggactgatctagtcaccaacacagctttggattgatcccaggggtgggcacaaaactcttacactattactgatgctatgttgtgcttgctgacagtaagctagcatagctgtcctctcagagcctctaccagcagctgaatgagacagaaacagacactcacagtcaagcatcggactgaggttggggacccccatggaagagttaggggaaggactgaaggagctgaaagggaaggcaaccccctaggaagatcaacagtgttgactaacatggaccatgaaaactcacagagactgggccagcaaccaaagtgcacaagaaactggtctaaggccccaggcacatatagagtagaggactcccttgtctggcccagaagaggatgcaactaatcctgtagagacttgatgctccagggatgggggatgtctgggggagtaccctctcagagatgaaggggagagtggatgtgtgtaagaactctgggagtgggggtgggggagaccaggcatgggtaacatttgggatgtaaataaataaaataattaataattataatatttttaaaagaaaaaatacatgaaatttaccttgttaaattttatctgtaattccatcttaggcaaaaacttcaagtaactattgtttgagaccacttagattacaatagtcatgagaaatcctaggctgcagttttggactctgtatcaaaaacagcaaaagaactaataataaatcagggtagaattttacaaaggaaaaaaattttatttatctgagatatcagttaggcaaaagctgttgcaatcacttacttttacatgcctgaacaaaaggacagttcaaatgaaatcagatgattattagtgttttcaaatccattgagaaatacaggtgtggatcaaagtaaaaatgcatacttagcatgttacagttcctgagttgaaaccaaactgtttcaatgaagaataaatttgaggcacctgtgagtaggtagagaaggtaaagtgaactccagccaaaccaaattaccaacgttttagaagaaagcatcctggcaaaagtagagaattgatttccacatattttcctctcaccaatacaggtgcatcctcccaaaagtagattcaagtaattttaatgtcttaggatgaatgaacatggaatctatatttgtttttaattactaaattttgaaaatagagtttctcagacaatatattctgattgtgtgccactctgttttctcctacctgattcttgccacctgtataaccacctaaatcttcatgttctctctctccccttagaaaatatacaaccaaataataaaaaaactaaccaaaataaactgaatctaacaaccaaaggaatcataatgaaaacttacaagaatcacaaccacacagagaaacatatacccaaacataaagacacattttaataagttataatgtacaaaaaattacaagtattgtttaaaatatagtacattatgaatcaaaaataataaaacaaaagtattgttaattcacatcagttgtctgtctactacatggaatgaggattctgcatcatcatgtggattctatactcagtaaggtactactggggtaaactagcttttctatttggaaaattcattaaatggagatatctccttgaggttgggatgtcatatattattcctgttctcagttcatgggtcccaaatagctttgaccagtacagacactgtgcttgtgtcattctctgtagaagttcatttgttcatcagccctagtatgtctggaaggtattgttgccttgctggcattccttccagcaccactggccttagtatcattctacaatgtcttctacatattttgctgatccatggagtagaaattcgtatggtaatttatgattggatgaaccaaggttttgctatgcacattgtccagttatgggtctctgtatatagccccatctactctaaatattgcttctatgatgaagatgcaaaatacactaaactatgggtataataatgtaatttgaaatacttttattgatacatatcataccttattgtggtagatcaaatagtatcgagctgggttgttttttaaatttccagtcaggtataatacagaatattttcaatatcaccaatactattcaggagatgaaggcccatgcttgtcttctctatgttcaacagaaatgtaagtgttatcatctgtaatagagccatcattgattggtatcaagcaatcaacatcttaggcaattgtctgagatgtgtgtggagtactgggtaactcaggatgatttatttctgctttctttaactatgagttctattattttcttaacagctaagtaatatttcattgtgcagtgtaccacattttcatggatagctaggctgtctcctctttctttctcatatgaagaaactttcaatgaataggaatgagtaagtgtctatattaggctatagactccttttatatatatatatatatatatgccccaaaaatggtatacctggatcttgaggtacaacattcccggggtcccaatgcaaaatcacactggtttacaaaagggatgaactgctttgcatttccaaaagtagtggataaggattcttattgctcaccatcttccctagcatgtggggtcatttgatttattgatcttggccataatgattagttgaagattaaatctcatgtggtttgaatatgcatattcctgattactaagagttttgaacttttcttttactgaaacaaatatttgaatagtcaattaagggtcattagaggaagggatttatatgtgaaaacaaaagggataagtaggggaaagacattgtgtatgtgtgtgtgtgtgtgtgtgtgtgtgtgtgtgtgtgtgcagttttgttctttaactatcataagacaggccaaccacctgatgaatacaattttgttaatttaagaaacatctagttcataagtcagggataaaaaactatgaagctctaagaaacatgggcagatttttgatggggaaaaataaatgtggtcaggaaatcaaagagtctaccgaaaagtaaattgcaattaaacatgttcacatgcattctcagggcaaaaaacatttttagttccctatatctcagacagatttcattcttagccctaaatcacaagccaagtgatgcctgaaggagtgattacctctgtgctcacagggccatgtagcttttgacaaaacaggaagattgatggaaaccctacaaaaagttcttagtagaatgcagaggtatatgaaacaactgtgtcattttaaaagtatgtaaacagtcatctcaaagccaaatactatccctggtttctacataggcccttgaaggtatgttctccttcagagaaataggaagaataatatagatacctgttagctgtcacatcacattatataaaattaacacaatagttaaagacctcagcgcagtagctggatataaaattacctcaaacaagtcagaggtttttctctacaaaaaaggataaacaggatgagaaagaaattagggaaacaacacccttctcaatagtcacaaataatataaaataccttggtgtgactctaactaaggaattgaaagatctgtattaaaagaacttcaagtctctgaaaaaagaaattgaagaagatctcagaagatggaaagatctcccatgctcatggatgggcaggattaatataaatcagataggggactaatatccaatatatataaagaactaaagaaggtggactccagaaaatcaaataaccccaagaaaaaatggggctcagagctgaacaaacaattctcacctgaggaataccaaatggctgagaagcacctgaacatccttaatcatcagggaaatgcaaatcaaaacaaccctgagattccacctcacaccagtcagaatggctaagatcaaaaattcaggtgacagcagatgctgacaaggatgtggagaaagaggaacactcctccattgttggtgggattgcaagcttgtacagccactctggaaatcagtctggcggttcctcagaaaattggacatagtactaccggaggatccagcaatacctctcctgggcgtatacccagaagatgttccaactggtaataaggacacatgctccactatgttcatagcagccttgtttataatagccagaagctggaaagaacccagatgcccctcaacagaggaatggatacagaaaatatggtacatttacacaatggagtactactcagctattaaaaacaatgaatttgtgaaattcttaggcaaacagatgtatctgcaggatatcatcctgagtgaggtaaccgagtcacaaaagaagtcacttgatatgcactcactgataaatggatattagcccagaaagctagaataccatgatacaacttccaaaacacaagaaaatcaagaaggaagaccaaagcgtgggtacttcattcctccctagaatagggaataaaatatccatggaaggagttgcagagacaaagtttggagctaagatgaaaggatggaccatccagagactgccccacccaggggttcatcccataatcagccaccaaaccctgacactattgcatacacgccagcaagattttattcaaaggagcctgatatagctgtctcttgtgaggctatgctggggcctagcaaacacagaagtggatgctcacagtcagctattggatggatcacaggacccccaatggaggagctataaaaagtacccaagagttaaaggggtctgcaacagtgtagcaatatgaactaatcagtacccccagagctcgtgtctctagctgcatatgtagcagaagatggcctagtaggccatcattgggaatcttgtgaagctgcctgacttaaaaaatggatggagaggcatattcgccatgagcacacacagcatgcagatttaaaagagaacctgattaattagaccattgtgtatataatatttatacttccttctttaatgtgcattttcttccacatacttttcatttccgttacactacaatttatataacaaaaaggactttattagtcaacgtgttgaagctggttgctctttaaaatttcccttcactgtgagagttgccacattcacttttctcagccacggtggaggaggcagcacttctagcaacagtaattgcagatacctcccacgtggtggttattaccactctggattggctcaggaatttttcattatggttatacaactaactctgtacagggatgctgtgggtattagaggtccttctgaatgatcagtagcagttgtgtcagcaggtggatcctgttagcttctgaatgcaagcatgaaagcaggcccatctcaccctagtttcttttttttttttttttttttttttaacaggaggacaaatcttttcctccttaaattaaacactctaacatatatagcttttggcacctacatacctccacacatatgcacacatacacacacatacacacacacacacacacagagagagagagagagagagagagagagagagagacaaagacagacagaaacagagacagagagacagagaaagagaagaaagaccaacagaaactgagtgatagagacaaagattgagacagagagaaatatgcacacatgactaaaaataataaaatcaagataaaagtggtggcacgtgacatttttttcaagcacttataaggcagaagctggttaatctctgagttcaaagccagcccagtctacaaaagtgaatgcaaactctatcaagtaaaaccctgagaaaaaaacaaacaaacaaacgaatatataagtattcatggcaacaattttttaaaacatgaggcaaaaattcatcactgaatgacaaaccaatgctttcataaaacaacaaataatatgttcatggtaagagttccatttacatgaacacataggaaattttaaagatacgcctaatcaaataaacctgattaatgcagaacgttgttaaggtagcagcttttattgcttagtgatttctcctgacagaactacaagtatctaccacttttggactttccttaggttgtttagattttttttctaaccactctttctttcctttgtatagaaatcaaaaggtgaatataattcaatgttatgtagtcatcattgcccacaaaacagcttgaatttattcctgaccattttatacaggggtttatgacaaccccccccccccccccgttttcatactagcaatggtacagatcatagctcatggctgcctgctttttcattagctttagaaaagattttaaatccctgcagcctggcaaacatgcacgcatgcgtgattggagggctgtgcaggctcactagcacaaaatgggggttgggagtgtgattagtcaattcagtgcagcaggtcctgctgagccaaagatgcctgtcacatccaccctaggaatggtcagcaaggcaatgcagcaaccaaggtcagctcccattttgaccccttgtttctttaatagatatatatgatttgtgcacattaagtagtgcaagcttgatgggattagaacattatcctatatatttaaagtctttgaagaatcagtttagaaaattaccaggttaggacctggcttcctttgtcctgtcctgtgttgtattggctgcagtgcccctccctttgagccttcaatgtgctctgtcaattttgctcagttctcttacagggtgaacattaatatttcaaagaacagacagtattgtggattaaaggtgtgtggaaattaaaggcagacagaaaaaaagaacatttattttggtatatgggtgttgcacaataataatattcctaaaggaattaaaattatattgtgccttgctgtgaatataattaatgatgggaagggataaaagcacttgagagttaacatgcagatttttttcagagggaaatcacaacagataatggtgatttgcacctcccagtttctaaagggataggaggaacaggtaaatacgtgttttgacactttgatacttataatacaggaaaggggattccaatgtggcattaagaaagtaagtgtacagagtaaattcaggtgtgtgaatagtcaatgtgtggaaacatgaggtatctttacaaacagagatatagcatacatagtggtacagaattataaacctttgttctgtcatcttgtaatgtgatctattttaaatattgttatactgcttctgtgttgttaggtatttttatttattaattttttttaatctacagattcacaaaaagctggtgaatttggaagtaatttctttgaacacttaatctattctgtcctctattctcttcatgttgatgaagcttataagatatgcaaaggagcatgcacaaataatttgtggggtgactttctcaaagagataaattcacatgagtgagccttgtctttgttttttgtgtttggttgtttataggtcttactggaattctcctttaattttaatacaatatatcatgattacagtttcccttttttttctactcctcccagttcttcctcatctatcctcccttccagcttagctctctttctgtctcatacaaaaaaaaatcccatccaaaagaaaaccgccaaacctataaaaatgaaatatagtaagatcaaacaccatcatattaagggcgggcaaggcaacccaacagaaggtaaagtgccacaggagcaggcacaagactcagagacccacttgttaacacactcaggaatgccataaaaacactaggctgaatgttgcaacatatgttcataggatccactgcagactactgtaggctctggaacagagaggtccacagaggaatgtcctttgctttttgtcattttatttaggttttcatttcaaaatgttgggatttcttttacactctatattttatcccacctatccacccttcaactgttccacatccaatacctcctccccaccccctctctccacatggatgtcctcaccgcaacccacttgacctataaattcactgggacctccagtctcttgagggttaggtgcatcatctctgaatgaatacagaccctgacgtcctctactgtatgtgtgttagggggtcttatatcagctggtgtatgctgtctgtttggtggtctgtcgcttctgtctccgaccagcagaaaagagtgacaacacagcattcttctcaaagcagtttattcaggaaccgttcaacaggcaagcaggaatctctcctagcccccaatcacaatcccttatataacccctcaaccacaccccaatagcccagtccatgtaatctcagttcattggccttcatcaaatggcctgatcttgtgtcatggtgtgcctgcgcagctctcacgatggacatggcttatttttgggtgtatgaggaagtcaggtgcaagtcataagacttggctgcagtcctgggcgccatcttgggattaccgccacacccgctccccacactggtccagtgtttgagaaaccttggaggtccagataatttagactgctggtccttctataggattatctttctcctcagcttttttcagttcagccttctctaattcaacaacaggggtcagctgcttctgtccattggttaggtggaaatatctgcatctaactcttctagctgcttgttgagtctttcagaaagcagttatgataggtaccattttgtgggtgctccatagcctcaataatagtgtcaggccttgagaccttcccttgagctggatcccactttgggcctgtgtctggaccttcttttcctcaggctcctctccatttccatccctgtaattctttcagacagtaacaattatgagtcagatatgtgactgtgagatggcaaccccatctgtcacttgatgtccagtcttcctgctggaggtgggttctataagttccctctcctactattgggcatttcatctaaaatccctccctttgtgtcctaagagactcttagagttcagttctctggtgcattctggaggatccttccaactcctatttcctaaggttgcttgtttccattctttatgctggctttcagggcttcagtcctttttctttacccaatatcagatcaggtttccctctcccccacccctctttccttccttgtccactttccctcccaggtccctccttccctccccacttgtgattgctttcttttctctcccaagtgggactgaggcctcttcacttgggcacttcagcttgttgacctagaactcagagttctgtggacttatcttgagttttcagtactttttttggctgtatccacttattggtgagtacataccatgcacattcttttgggtctgagttacctcactcaggatgatattttctggttccatccatttgtctgcaaaactcaggatatcttcgttcttaatagatgagtagagttccattgtgtaaatgaaccatcttttctgtatctattcttctgccatgggacatctaggttgtttccagcttctggctatcacaagtaacagagctatgaacatagtgtttccaaagtagaatcacgtgataacccatgccgccagtattctgagggtttcttaaagttcttgcttctcaaatgttgctaattaatgaagttatagcataatagtaccataccatacaccttttttttactttaactgtgtagtataaatttaaatctgatatagtgctacctcttggaaattcttttattatttaaggtgggggttttttgttggttttttttttttttgtattgagtctttttgtttccatatacagttaaataattataagctgaatttgggtgaagtatattgttgactcttacattgaatatgttaaaattacacatggtttctgggattctttgacttaaaattcccagtgaactgatcattttatatgtcactaagattttctttaataataaatagcttcttggagtattattttcacaaaattagatatttctctttgcactaccataaatacatatgtgtatacataaaataaatgcttatatagaaaataataaatactccatatccattacttatggataaatgtatatgtacaacatgtaacttttattataataacacacaatatactctattttataactcataataaactacatacattactagtaaatctagacttttttggagtatggagtttttttccataagtatatgtacacatacacatatatttatacatatatatattcaactttacatataatatataaagtatactctatatatttgatatctatatataaaatatatatatatattcagctttacatacatttatatacacagtatatacatatatttatataaatgtcattacattatgatcatggatagctaattttttgtgttttatatttatatattagtttattatatattgtaatgggtattgtattacatgttttaaatataaaaaataagttctatgtacttatgtatataaataaatatatagctctgataaaatacttatgtacttcatatataatataaatacacacacatatgtatatatatgtatatatgtttcataaagattcttcatacaactgtatttttgctaaacataatccacttatttcacccaacataaagaactatccctattcctgattaaacatttagcttccagtactctttctataatactttatgttacatatgctctaatattcttacttaatattgtattaaatagtatatgctaacataaaagtttccaagtaacttctatatgtacatttcactttggctaaaccttgatgttgactctgacttttccaaactcaatcataccactatcaacataaaacttctgcctccagaaatcccctttctactttcatttactaagtattatactcccactcctctataaacacattcctcaatgactagtttccaatatcatatttttcacatggcctccgtaaaaccacacaaaacaacagatcttacatagccgcctcatgtgtcgagaacagggagcatttgttttctttcagattttattgatcactcactgctactggttcttctcattgccacctgtctacctgcaaatttcacttttttactattgaacattatttaactgtatatgtgcactgcatatatgttttaaaataaatatatggaaagcatgatgttattaattattcacatgtgcgtgtgtatgtttcattattctgtctgaagttatccagattgatcagaaccatttagtaaaaaaaaaaaaaataaaaatgttgttcaacaaaccggtaattgtatcagtgtgggattatatgtgagtcattatttcacttcagttaatcaatgtagtaagttttatgccatattgtgtagattttgtcacattagcaccatgtaaaatgtgggatcctgataattctttctgtttaattatttcggatttttttacatttattttggcttgggttttttgttgttgttgttggtgttgctgctgttgctgttgttgttaggttttagagttttttggtgttgttgttttgttttttatttaattttttttggaaaggtgaaacttcttattcccatatgaaattaaaattacatttttaattttgtatgaagatttttttggagattacactaaatgtgtgaattgcttttggaagaagggccgtttgtaaagtaatagctttgtcattttattaccatggaggcattttagtctgtaatttcttcttcaattaaattttctagttacttaaattgtcaatgtagccttttacattttagttgtgtgtgtgtttgtgttggaaatggcattacttctatgatttcttaaatactaccttagttgtatatgaaacctactgaattttgtgcactaaattttaatcctgtaatttgtgctgggtgtatcagttgcaacaggttactggttgaaaattaaggacaatttatagattgaaacacaccctattcaaattaagatatttgaacatctgactttccttgctgtatcatgtctttgtccttcactctttttcttgaactaagactcctaataatgtaataagtaggtggtgcagagtaaacatccttgtgtttttccaaagtattgtcattaatacttatctccatttactacgtttctggattttaccttgatatatattatctctcttaagtcaaaatgtgttctctgtatccttacaagtggacacatttctaaagaaaagtgaaacttgctcacccagcgcccatctatgataatgagcacccatgtgtatgactaaaccatacatgagtattcatttactgtacttggaggttttagtggtttttcatttatgtattgaccaacacagaatgcaacaagaatcatgtctaaccaaaccctgagaacagcacaaattgacggatatcatcagaaatctctttttttgtgtcagtgtctgaaaatgaccatttagaatagtatcaaatgattttatgctaggacctacaacttccctcctcatgtttttttttaactatgattacactgccatgcctgatttttcacccttagaagaaagtctcaaatgaaataaagaagcagttgcttagtccttagtgcagtttcactgctactgtatctttggtacactttacctctcatttcaatattgtagcctgcaatgtccagcagaagataaaaataatcattatcttttctcttgctagcaacgtaaatagcattttcttgtagtattaaagatagctaacagaaacaattatcaggttagtccaagcttgattttttttaaatatccagcaaatgaaatatgtgataccttcaacaatgtgttcttcatatttttatggggaatcaaaaataattgcactatcctgttatttgtagaatctttttgttttcaatgtccagtaactccaacctaagtaatttttgtctttcaatgaaatttgtatttaataacccatgtattcttgaccttcactgtctgattcatggcataaggtataaggctttgtcccagaatgtatccacaccaatctatgttatcttgatttcttataagtctaacatttggataacagatttgttactagtaatagtcaatccatgagtaaaagaaacattttttgttagaaaagaatatattccacctttaaattataaatcacataaatcactgaatgaagacaaggcattgactcaaggaaggaactggaggcaggaacttaagccgaagccatgctgctgcttaccagttttcaccatgtggctagctcagattgcttccttatgaacaccaggatcatctgaccaggtgtggtaacacacaaagtggactgggttctcccccatcaatcatcaattaagaaaattaccccacagattggtatataggcaaactggtagacacagttcaactgaggttctctaatcccagaaaactcaaattgagtcaagttgacaaaaaaaagcaaaataatatgcacatataatataccaaatacatatttttatatattacagaatatgtttacataattgatatacacttttggccagtggatcagatttcaaagacaaatacaaaacacaattcaatgaacagttgattttatatgcacctacaacttcctggtttttacctttctttacataaatatttataaatcttttgaaataccaaactcaaattactttttaatgcacttttaaaataaagaagaaagataataaaatgtattcaaattctccatctgttgagcatttctttataacttttccattaattaaatatagattatagtcttaccatattgtgtgtaagtatgacttgtatgcaagtgtaggtatatacatgcctcagtgtacctgtgaagttgagaagataacttttgagtgctggttcagtttcttctatatggcttccagatatcaaatttaggtgtctaagcttgcatggcaagtgcttttagatgtccagaaatttcactggcctctttccattaacagtttcacactaattaattaaatgcatatagtgaagtaccacatcattctcataatatatgtgtgttttatggcttattttcaggacagtttccaacaactggaaattggagtcagttccttaaaacattatgatgcagattgtcaatatattctaatttaaacttttttaaactaatttcacttactaaaatttttattagatatattttactttcaaaggcccacaggctgttacatacggacacagggtcctgcaagaactatgaacatacaagtaaatattctaaatgtttttattttaataatatcaagaaatacgacttaccatattataccaggatataaaattgtgacttgaaacaaagcatgtattgtgaagtctgctataactcttacatggaagaaaagcatgatttacattgccaaacccctgaaatagtggaaagaaattgcactgcggatagggaattgtgctgtcacaaggatcaatgtggaagagtctggtttctccagtggtttgtggaagaacttgaatgatctctgtctttaagacatgtcttttggtttccttcaaaatacatctatgttttattattatatagcaccaaaaatggtatgatttgacttattggattgacttgtactgggaaatcaagtagccctcgatttttcatctctgggttacatggcatgacatggttatatattctcactcaattacataccaattgctgacccctctcctggtctgaccttcacacaggacttccctccatacctagatcccttatcatttgagagagtggattctcccctgggtatcctcctaccatgccaccgcaagtctgtgaaaagctaagggcatcctcttactgaggacaataagaagccaggcaaaggaatggattccacaaacaggcaatagatttagtgtcagcctccactccattgttgtggaatctagatgaagactgagctccacatatgctacatataagcaggggtggggggctaagtccatcacacgaatgctttttcattggtggttcagtctctgagagaccccagtatccaggtttgttgattctgttcatatttctgtggatttactatctcctttttggacttcaatccttttctcaattcattcaaaagatatcctatatgccaaataatgtttgtctgtgggtctctgtatttgtttcggtctcgtgctgtgtagagcctctcagaggatcctaggtttctatctggaagcataacagagtataattaatagtgtcaaaggattagtgcttacccctgggatttgtctcaagttgctcaggatcttgtttggccattccctagatatctgctccatcttcatccctgcattttttgtagatgggacatattttgggtagaaagatttcattgttgattgaactccttatccctccacttacattcttgcctagacattggttttagccccttcaggctcatcttctcgcaagagagacatttaaatgataacatactcttatcttatctcttctgtaatttaactatctactggcctgggttttcatgtgccctgtgggtatccaggctccctagttcaccaagctggaatgcaaagaatgaatcataactgggccaggtagttttgagaggaacttggtcggcatgagtgttggataaattgccttctccagagatgtttttttttttttttttttttttttttttttttttttttttaccaaaacagcacttgtttactggggataagaagaattatataaaccttgaggcagagatagagcttttggggagggggtgagtatacaccattaactgtggctgaagtgctaggaatgcttcatttgcagaaagaagggttccaggtgcttctacatcctcacactgagagaagtttgaccagtaatttggtcaacagactaagtgactacctcaagggtgatggaggtggggacataagaactatgtgcactgggacatgcaggcccagagcaaggatgagattttcagggtttggacaggtcttgaactcattcttcctccagactggctccccccaggtaattcctttctggctccaaaactatgctctaacatctctatactgaaatagatcaagacaaaataatggttcacataaaattattacttacaaacaccagttacaaaaatattgctacttaagaccaatctttggtaaatttggaaataaaataaactacccaaatgaaaaatatgaaatctaaaacaaggataaattattttgcatgacctacacttataatattttctaaaatatgaagacctgtgtatacaatagaaataacaaggtcaatgttgataaggtatgtgatagcacaaggaatctgtgagtagatagaatgtttgcttttctaaattgctattgttacttctgttattcatactatggtaattattgttacaccttcatatacaataatcctgttctacagtgcatataaatataatgtcaagtacagcagaagagagtggtaatcacacctggatcatgagagtaattaatattaatatgatcccgaattttttttacttaatgcctttaccaatgttttgtatacccttaattctgtctcatattatctatcaccttttaagaaactttctgtgatggtttgtatgtgctctatgctcagcacagtaatgtcaatattagaaggtgtggacctgtaggagtagatgtgtcaccgtgggtctgggctttaagacactcagcctagaatagtattccacggtgtaaatgaaccacattttctgtatccattattctgttgtaggacatctgggttgcttccagcttctggctatctcaaacaagaccagtatgaatatagtggaacatgtgcccctgtggcatggtagatcatcttttggtatatgtccaagagtagtacagctgggttttcaggtacacctatttcacattttctgaggaacctcctgattgatttccagagtggttttaccagtttgcactcttgccagcaatggaggagtattcctctttctccacatccttgccaacttttgctttcacctgagttttttttatcttagctattctgattggtttaaggtagactctcaggtttgttttgatttgcatttctctgatcattaaggactttgaacagttctttttctgtttctcagccatttgagattactttgttgtgatttttctgtttagttctataccccattttttgattgggttgtttggtttcttggtggttagcttctcgagtatatatatatatatatatatatatcctgtatcagatgtagatttagtgaagtttttttcccaatctataggttgccaatttttcctattgactatgtcctttgcttacaaatcctttccagttccatgatgtcccatttattaattcttgatcttcaagcttgtctgagccattggacttctgtttaggaattttccccctgtgtgtgagtttgaggctgtttcccacattctcttctattaggttcagtgtacttgtttttagtggatgttagcttaaaaagtacagagtatccaggatacaattgacagaacccaggaaatgtaacaagccaaagggcccaaatgaggatgtctcagtcccacatgagagagagaaggaagcaattacaggggaaaggagggtgggagggacacagaggggaagggagaaacattatcaggtacttgtgtggggggacaggactgaagccttgtgggccagcagaaataatggaagcagacaacctcaggaggtagaagtgagggaaccctctaaaatgtaacaaagacctagaaggtgagagactctcaggaatcaaactgaaagacattaaatgaaatgccctaccgtggggagaggtaatgtgtagagcccacctccaatagaaacacggggtatcagttggagggatggggtttccatcccactgtcaaaactctgaccaagaattgttctttactgaaagaacttcagggacaaaaccaaagaggagcatgaggaaaaggaggtccagtgacagccccaagttgaggggaggccccaatgcctgacactatttctgatactatggtgtgtttataaataggagtctatcttgactgccctctgacacccaaccaatggacagaagatgttagcccccgtggttgaagtagggaaaagctacaagaagctgaggaggggtacaaccctatagaaaaaccagactaaaatggatgcccaagatctctcatacactgagtcacaaaccaggcagcataaccagctcatatgaaacctttaacacctatacagcagaggactgcctggtctgaactcagtgagagaagacacatctaacccacagtgacatgaggccccagggagtgaggaggtctggtagggtggggaaatcctcttggagacaagggagaggaggacttatgggatgagggctgactgggagggggataaaaactgaactgttaaaaaaaaaaagacttgtattggtcatggtgtctgtttaccggagcataaccccatcaaagataaaatttggtaccaaggactggagtatctttgtgatagaactaaccatgcttttgattggagtaatgtggatttctgggagtttggaaagcagtgaaatgctttaagttgggattaatgacttattctagtaggaatatggaaaactttgttgctgaatatgattgaactataccgacatagcccaaaaggtttcagtggagtagaattcagtatgtggcctagagactgtttttgtggtattttggctcctttttgcctttgtttgtatagtctccctgaggctgaggtaatgagatttatattaattgcattgacaaaggaagtctcaaaaaagcccagcagagactttgatctctgattaagtctcatgaagagcattttgaataagcatagtgatcttagaaagaaacaatataaaatatatggttcaagcattaaaggggctccaggaagtgagatggaactgaaacctatgtgctaggagaaaacagattaagggttttggggcaagatcctacccagctatgtttagatacaagtatggtgatataaacctttaatctcagaatacaaagccaagcagatctctaaattcaaggacagcctgggactgagcaagttctaggtgaaggaaagtttaaatccaggtgttttaagacccttaatcccatgagcagagcatgcagatctcttagttcaaagtcagtctacaggggaatttccagaacagctaagtttaggcagtgaatgagctggaaaacagaaagctggtgaaaacgtaatataacaagggaccaagttccagctgcagtgagcagcagaactcaacagatttgatcatttggctctatttttatagtcaagaggatgagactgttgggacaattgatgctggttagctggagctaagagcttagcatggttaagaggagaccagtatcactgagggaaaatcttctgaaaagtgttttctgagaggacaacgaagctgtgttctagagataggcaaggttgtacctcatgttgcagctgtacttggtaatgtgtaagactcacccaggtggtactagttttgaaggcatgaagtggtcatgaagaacagctgatgcttggcactggagggggccatggaaaaccactggtgaaggtgcatcctcagttctatgtgacagcccaggaatgaagtggtctggcaaatgttttgatccttgacaccatgaagagaacctatgagaggttattggtgaagcctaattgtattggaaatacccagcatattggagatgccagtaccatggactgatcaccaagaagagcagctgcaatggagtggatcaacctgagcttagagagctacagagggcagagctggagaagtgatgctagccctttggaggagcacagaggatcacgggtagatcctagacattgaagcaagaagctgtaacattgccattgccttggggaacacaagatgttggagatgccagagccatgagctatctgttattgaaggcagcacagaagaaagaagtttgttgcattcaacaaagattaaaaaaaaaaaaaaagacttggagatcggaaacccactttgacatcagacaaggacatacatactttgcagtttttccagctggtttcctgtcttgctttggaattacagttaagtaattaattaaatctgagaatagtccttggacttttaacattgttgagagtgctatagactatggggactttggaaattggactaaatatattttgcattatgttatgtttaggtatggcctccatagattcatatgtttggacaagcctaagggggccagggaataaaatgttatggtttgtatatgatcagctcagggagcggcaatattaaacttgtggccctgttggagtaagtgtgtcactgtgggtatgggctttaagaccctcatcctagcttcctggaaggcagtattttgctagcagcctacagatgagggcatagatctgtcagttctgcctgataccagtgaatcaaggatttgaatggtaaactatgtgtcattagaggaagggatttatagttgaatataaaattgctatgtagtagaaagccatgggaaatagaggtaaagaacacaatgtaaggtttagtattcagagagaaaacagcaagtaaggcacctaagcctttgagatatacttcagaggagttaagcaagtgcattttgtgtgtgagtgtgcatgtgtgtgtgtgcacagtttttttctttaatcaccataagagaggccagccagtggataaatagaactctgttaatgaatttaagaaacatctaatttataagcctgggaaaagaaactatgaaactctaaacatcatgggcagattttggatatgaaattttttttaaaaatgggatagggaaattaagcagcctacatcaaagtaaattgccattaaaaaaaatgtattctcagggcagaaactccctttagccctcctaaatctcagacacagatttcattctttttgataaaatcacaagccaatgttcagtatcatgtagcttttgacaaaacaggaagatttatggaaaccctacaaaaagttcttagtagaacacagatgggtagggactatgaaataactgtgctgttttaaaggatttaaacagtcatctcaaagtcaaatcctaaccctagtttttacaggggccccctaatgtatgttttccctcaaagtcttaggaagaataatgcaggaccctgttagtgggaacatcacattatacacaaattaacacagtatttaaaaaaaaatcaatgagtatcctgtgattgattctctgactttaaaaaaggatggagagaaatagttgccatgagcacatacaacatgcaaatttaaaagagacattgatttattagaccattacatatgttatatttatacttcattctgtataggtgcaatttcttccacacaattttcatttcagccacactacaatttatgtaacaaagatggctttattagtcaaagtgtcgaagctggttgctctttaaaatattccttcactatgagatttgccacatttattttcttcaaccataatggagggggcagtacttctggcaacagtaatttcaattatcgccttcaatgatgctccttagcacttctgaattgacctaggaaatgtgctattttttcattagggctgagcaactagctctgtacatgggcgtggtaggcaatagggatacttctgaatgatcagaagcagttgtgtcagcaggtgaatcctgctagcttctggatgcaggtagtgctcagaagtcatcttgaagacaggcccatcccaccctgggtttcttttgctacttaaatctaacttttcctccttaaatcaaccagtctccttagaatgattgcttatcaaatttttcaacatgttgtaaagcccaaacaactttgttttttataaggcatctcattttgtgagagacgaggggctaagctccaactctaagaagaaaatcacaaaatccactgagcaaacatcttatggaaaccttaccaacagccagtcaggctaaaatagcagagtcaaggtacatattggaattctgtctggactccacccccaaagatacctggcaacatctaggtatgctcctccccacagttacctggaaacagccaggtaggcatgtcccactataaaatgagctgtttgacccctcctccctctcttacactcttggctctcttacctctctcttagatcccttcccccctctctccacaggaccatggctagtctctacttctctactctcttcttctctctgcctatatctgcctctactactctcttaactctccaccccatgccctaaataaactctattatatacttcctatacctactgtgactggtctcttagggggaagggatgccttagcatgaacccactgaggcacccccttcccccacatcccatcagaacacattcttatagctctttctctttttatgatcacagcattggtgcattgtgactcggatccagaaactctagaggtttgcatcccacctaggctaccacaagagatagttaacttggatatcctgttcatcagatggatttgtccccatgtttcagtcctgcagagtacaccagaaatagagttttttaaacgtcctaacccttataaaaagtccccaagtttgctgtaacaacaataaaaacactaaaaccctagattggggactctcactctgacatgctgtgacaggaactgtgggggaccgtgatctatagcttataatgaagaccattatgtatttatgtcagaattgcctctgatatggtcttttggggggtccctgtaatttgagcataacactaacccaccaatttaaaagttctatttaccttgtttcttgatgttgtactctggtttgtacctttctacaaacagctgataagacaagtgtttcctagaataaacataattctgttcccaaagtgtctttaccctattatatatgcttacacgaagcatggccttgagccaaattttttaattcttgtttttatcagtattagtggtattcaatttctattgtcttacatttaagattttttttccataatttttcttctttgtttattttctcattcattacatcaccatattttccacaaaccactccaggtaagtctcctcaatatctttcctctcatccagatccactccttccactccctttaaaaaaaacaaaaaacaaaaaaactggtttgagaaggatgtgtcaggaaaacatactaccttagcataaagagtttacatttagggtacgatgaaaacctctcagccatcctgggtaaagaaaccatcagcaatttaactgcttcaggatgaagtaattgaaagggtttattatgatggatggtatgtttctttgttaacaaatacttttaaatctcattttttagaattttctgatgagtggatttacaaccacgccaatttgcaaaagatgttttctacatagtaccgactagaataaacccacattcaagttgagaacatccttttccttttagtaccctcaacaataactaagatcttaatgcagcttcctgctctagtcaagagacatgctacaggaactaagtcataaaagcgctgcatggtgtggtgaccctccccaccaccaaaaaatagtaagtagaccatggatattaggatattgagttagtaacaccaatgaggtttgattttgctttgttcaaattgttgcttgattcttctctcttgaagtaagaaggtagtttaatttttttttaattttacaagagcacatttttcaaaatgagattttagagttttatagagaatttggattttaagaagcattgcattttttaacatactgaatttttaaagtgttcgttttggcaacaatgtgggtctttgtaagtcccaggacagatatgtttgatattcaacctgtggtaaattacttgtccaacataaatagatttgagtttgatcttcatcccaagtgaaggttaaattgtacacagaaggaactactgcatccaggagacagagcagtaaaaatataaatctcaaggccatcctaagcatttctcaggacagcctgagtccatttcagaggaaagttaatatatgctctgtgccattgtgttctggaaatatgtaacttgcttttgattttacatgtatttcattgaaataattgacttgaggctcagaagacacattgaatttttaaacaatgttcattctatgaaagataatggagtcttttaaagttgtacagtatacttttttatgatatgcttgtgaaagaaaaggtatagaatacggtggtttgaatgagatgccccctattagcatccaatttttaaacacttaattctaagttgatggctgtttggggaagattaggagatgcagcattgctggacaaaagatatccctgatgtttgaaacatcatgatgtttcaaagagttctctctgcttgccctctgtggtttgagatataagttgctaattcagcaaactgctacttgccactaaagatacagaagactggaaataatcttttgctactacaattttaattttatgaatatattgttgttgttactataggattccaaaacgctatcatggctgtagttaatcaatgtggactctgcttattcccctcaggtggtagattaaagggcatgtgctcttttttcacaaaaatatttaattgcaaaagttattaatgatcaaacctaaatgcacatttaagaattaaataaaaagcattcaagctctattgactcatgtctttattcatttcattctagagatagacccaaaaggattactagaaatttgaggtcagtctaatctagagaatgagacactatctcacaagttcaaaaaatacaaaaggatttgaacaaaaaaaaagaaattaagtaaaggataaaaggaaggaggaggaggaagagggggtgaatgagaggactccaataatcagagacaatgaaaaaatcaagaaaatggagtaaattgataatcacatgtaaactagaattctatgctatggaaagtaggggttttgcaaaaactgagaatataaagattaaacttctgtcaagaaaaataacaaaaacagtaagtacacaattctttatattcccagatagtgtacctcatgtcctttgggttaattttaagatctacaaattccacattgctacaactcttctaactgcctacattaagtatctattgaattgggcctgcatatttctcttccttacaaagatataataagcagtacacagaactttccataagtttccaaaataacaatatcaatgctagaattagaatcaaattatagattatgaaggcgtggttttaattcatagaacatgatagcttactgcacacatcttacaagtttttattcttagatataattgaggtaattattctctctttcaacttcatgtgacatagaatcacctgagatgcaagcctctgtcattcttgagcaggattaacttaattaattaattgagttaggatatcctgtccctttgggtaggaccaggttgaggatcctcagcactgtctgcttcactaacactttctgtgttccaggcaagaatgctacaacccaaagtttagagactgataattttacatgcacatccacaattacttattagttgtatgataaaaagtgcaatctatttaaaaacacagattttgctttaggtattttcagtgtcctaatctcactttgacacatagagtattgatagatgcagaaaaggttggattcattttcttgtttagctaaccctatatgatccttgagttatatatatatattatataaaatagaagacaggatagccatgatatgaaaacctttagccttaaccttctaggtggcagataaagatgggacactttttgtttaaaggcagtgtattctacacagcatgttcttggccagaaagagctattgatgcaaagatagttttccctttcccacatagactttgacgtgcagaaaatgatatcactaagtcaatattatatttacatttactggaaaagaattgaaagtatgaacatttaaaatcaggagccattctcctttttttgtttgtatttttatttgcatatgcagcagtcatctaaatcacagaggctttaaggtccatagaagagcctgagtgatgcttctgtgattaaaaaacagatactgttctgcaagaggatttcccagaagacatgtcaggattctaaaactacatgtaactgcagatctggagaaatattcagcctttggcatctacatagctctacacaaatgctgacacatgcacgcgcgcgcgtgcgtgcacacacacacacacacacacacacacacaggagggggttttgggggagagaacagacagagtctgagtgatagacagaggcagaggcagagatggagacacagaaagaaatatacacacgtgtttgcaattaataaaatctgggtaactgtggtggcacaagagtttacttgtagcccttatgagagcgaagcaggtaaatcattgagttcaaagtcagcccagtctacaaagtgacttaccagtccaggaatttctaacaagtaagagtctgtctaaaaaataaagaaatgaacaatcaagtaactatcttatagcaacaatatttggaaacacaagaaaaagatttcctcactgaatgaaaaaccaaggcttttagtaaacaacaaatattatgttcatggtaagtttttcatttacatgaacacataggaagttttaaaaatgtacctaatcaaataaatcccaattaatgcagaacgttgttaaggtagcatcttttattcctaagtgctatctcctgatagcactacaattatctagtgcttttgtactttacctcgttttggtaatgttttttataagcacactttttttcctttgtaaagagatctaaatggaacacaattcaatattatgtagtcaccattgcccacaaaacaccttgaatttatgtataaattgaaccaatgtatacaggagattatgatgacccacttctttcatactagcaataggataccataaagctcatggcagcatccttatgttattagctttacaaaagattttgaatccctgcatcctggcaaacatccacgcatgcgtgattggagggctgtgctagctcacaagaacagactgggggttgggagtgtgattattcaagtcagtgcagcaggtcctgctcagaaaagaggcaggcaaagatggctgtcacatccaccctaggaatggtcagcaaggcaatgcagcaaccaaggtcagctctctcataaccccatcatttctttcatagttagacatgttttctgcacattaagtatttcaaatttatgcatctcaaaactttgagtgatgaatcagatgagaaagctatcagatcaggacttgcattactttgtcttgtcctgtgttgtgttagctgcattgtccctccccttgagccttcaatctgccctgtcacttcagctcagttctcttacagggtgaacatttcaaagaatcaacagtattgtgaattattggtgtgtgggacaaagggcagacagaaaagaaaggatatttattttggtatatggatgtttcataaaaataaaattcctaaggaagtttaaatattcttcttgccatgaaggatgggaaaagataaaagcacttaagcattaacatacagcttatcggcagaggaaagactcaaaagactatggtggtttgtgcttctcaatttctggatggataggagaattaggaaggtatgaattttgatactatgatgcttattataaagaaagggggattccaaagtagcattaagaaagatagtggacagggtgaattcaggtgtgtggactgccaacatgtggaaatgtagggtatctttagatacagagctgtagcatacacactggtagaattataaaccttttttcggtcatttttaatgtgcattttgatattgctatactgcttcagtgtcattaggtacttgttatttattatttttgaaatctggcccagattaaaaaagaaactggtgacttgggaaatatttcttttgaaaatttaatctattcctctgtgttctgaccaccttattttgatatttataaggtatggaaagtagcatgcagaatttttttgaccattctctgatataaatccacaagagtgtgccttgctttttatttttttgtttgtttgtttgtttaaaggccttattggaattatattttgtttttcatttcaaaatggttttggatgtaagttttattggaaaataattttaatacaatatatcataactacagtttccctttttttctactcctcctagatcatccccaacctaccctcccttctagattagctctctttttatctttgactagaaatgcatgcccaagatacaatgaccaaacaaatcaaaatgaaatataataagatcaaagacatattgagagtgaacaaggcaactcaacaaaattaaaagtgcaacaggagcaggcacaagaatcagagatccacttggtaacacactcaggaatcccataaaaacactaaagtgaatattgtaacatgtttatagaagacacagttcagactgttggaggctctggaagggagaggtccacagagacatgtcctttgctttttgtcattatattttgtatttcatttcaaaatgtttggattttaggattgctaaggtatttccaaagtagaatcatgtggtgactcatgccaccaactcactatttgtgaaggttattgcttctcaagtggtgttcatcaatgcatagcaatgccatatcatacaacttttgttactttaactatgcagcataaatgtaaatctggtatgatgatacctcttcgaactcttttattatttaagtttttatctacactgaagtttttttgtttccatataaagtcacatttataagattaatttggatgaagtatatcgttgatttttacattgaatatgtataattatatatggtttctgggattctctaatttatataccttagtgaattaatctttgtctgtcactaagattttctttgataactcatatctgcttggagtagtattttcactaaattaggtatttctgtttgaactaccataaatatatacatacaaatatataaatatatgtaaatgcttatattatatataaaaatacatcataaatatactacttatatatatatgtatatgaataacatgtaaattttattattatactatgcaataaagtatatattatattacataataaagtatacacataactattaaatttggactagttgtacttgattcaaatatggagatatgtatgtaatatgagtgagcatacatatatacatatgtacatatgtgtacaaatatatgtatatatatttgtatatgtatatatactactttatgtaatatatgaaaaatactttatatatattatatataaaaagtatatatactcatataaatatcttcaaattccaatcaagtgtagctattttttatattatgtagttatatatgtagtttatcttgtattacaatacatatattacatattataatttgaaatttttatgttacatatatattaataaatatataagtatgataaagtacctgtaactcatataatatgtgtgtgtgtgtgtgtgtgtgtgtgtgtgtatgtgtgtgtttcataaagattcttcatacatcttacttaacatattccacttatttcacacaacttcaggacctatcttgattctcgattaaacatttagcttccagtactcttcctatatgattttatatcacatatactctagtatttttactattgtgttaaatagtataagctagtgtataagttcccaaataacttatatatgtacatttcggttaaaccatgctataaaccactatttttccaaaccctatcataccattatccacataaaacttctgcctccagaaatcccctttctactatcatttgctaagtattatactgctgctcctctctaaatgcattcctttatgccattgactagttttaaatatcatatttttcacatggcctctataaaacctgacaaagcaaaagaccttatgtggaagcctcatagggagtgaacagaaagaaattgtctttttaaagtttgaatgctatcactctctgttactggttcttttcatttccatctatctacctgcaaatttcattcctttatacttgaacatgagttaactgcatatgggtataacacacatatttttaaaatagatatatgaaaagcattatcattttaattactcatgtgtgtgagtatgtgtgtgtatcgcacacacatgtaccaaaacacatgtaccaacagtacctatgcaaagtcagatgaaaaaccttcataagtctcttttcttctaatgtttgtttttgagctatacacattttctcaggaacatttaaggaaaaagaggagggaagggggagagaggaagagacagagacagagagagagagagagagagagagagagagatcttattttcatgtacaaattatacatatatgttggaaccatgtgaacagatctgtgtgtaacaaattgccatctagggaacagagtaaacatttatagtttctgaaacatttatagtatcttgatgttgatgaaattcaatgtgctccccaggtgatcaatggtataggatgctgaaagatcatatctttaaatacaatcactaagtagagagaaaaaaaaagagtgagcacaagacttttaatcttagaacccactggatgtgatatatttccatcagcaaggctacaccttggaaaccacaccaaacagatccacaacctaggaaccaagtgttcaaatactagaatctgtgaggaacatttcttattcaatctatcagaactactccctgtcctgtaatgcctgccaatccagttcgaccactctcgtattctccagaaaaatctcatggcccttgtcattccattaatgaaactaaatgttgaaaaggtagaggactgtgcaagtaacatctgcccacagcttaacttggtgcaggaaataaatgaacaccgcaccttatgggatagataattgcctacccataggagaaataaaacttttaaaaacaattttttcagcaagtaatgttctcattgtgtagccctgactaatctgtactgagtatgtagacctggctagtccttactcacagggattttcctcagtcttccacatcctgggttcaaagacatatcccaccattcttcagcattatcttcagcattatttggcatgcatgtcttctaaaaactgctacagatgcttaaaaatcttccactaagttggtaatacagactgtgaactttttataacatttctcacaggtattcatggtggataccatgcatggttagaagcagtgggtgagtttcctgaatatagtccatggttttgctcaaattcaatggctatagcttagaaagggaaaggcccaaaggattgtctctggattgctattcattgctgctgtaccttttcatgtttatcattgttgtattcttcatatatctaaccagctgtgattggactggggagactctcactgcctataatctgctgtgattccctcttggaagataacccactgcattggacaatattcctgtagatcaatgttaaggtaaactttcataaaatattgtatagatgaattcttgattttaaataattaatgatttgactcaaatagacttaagacattatagtattttgtagaaagattaagaaggttgttaagttgttatgttgacagaatgatgtaataaagttagaattgagagcagattgtgtttcatcccttgtagaatagttaggactacataggttaaaaaagaagtacagtgactttcatttcttgaaagcatgacatgtacttggttgaaaataatagccttggttctagttagtgattaaatagagaaaaggaaaaaaaaaacatattcttgcagtttggttctgaatttctggatccttttatcaatggaggtagccacaggatttggtatgcactatgaaagacggggttatgaataaagaggaaatagttgtattaaaagcacagagaatagatgattattcaatgtgcctgaataagtcatgtgatacatgatgatttgtttctgggtgaatacaaattttcatcatctgggcataggacaaaacttgctacaacaaactggcttgtttaaactttaataatcaatgagaaaagaaatattttcttctataattttgttgaagatatttgctggccctttaagttgaaaatcttcattctcatctactcctattatctgtacgtttggttttctcattgtgtcctggatttcctggatgttttgagttaggatctttctgcattttccattttctttgattgttgtaccgaagttctctatggaatcttctccacctgagattctctcttccatctcttgtattctgttgctgatgcttgcatctatggttccagatttcttccctaggttttttatctccagcattgcctcactttgggttttctttattgtgtctacttccctttttaggtcttggatggttttattcaattccatcacctgtttggtcgtgttttcttgcaatattttaagggatttttgtgcttcctctttaaggtcttctacctgtttagctgtgttctcctgtatttctttaagtgagttattaaagtccttcttgatgtcctctaccatcatcatgagataggcttttgaaaacgggtctagtttttcggatttaaatttgttgttcaatgccaaatgttcagcactaaaaatatatacaagtaacactattcagacaaaacaggttatatacagaaaaatacatgggtataaatatatttatatataaatatatgcatccagtaatttggatatggagaaaagacatcattaatttagtgaagagactggatggtgatgtagaaatacttggagaaatggaatgaaaaatctattttcataaactaaaaagtattaaaaacttaattttatataaaatatatcactatttaagcccatgaaagatgggtcaaattgagaaggggcgtgctgccaagtcaaaaaacaaaaaaatgaatttaacctctgtgatccaggaggtggagagaaatgcctaccttaactggtactgagactttcacacatggacatttaatttgtgtgggcatgcatgtgtgtgtggttgtgtatgcatatatgataatgcactgacattaaataaataaatggtattctttaataataatttgatctttgacaaattctgggggctgtgcattcattattcatgatgtcatctccgaatattgatttaaaaattattttgattttagatggttggtttgggtttcaaaacagggtttatctgtatagacctggctatccaggatcttgcttcatagatcactctttctcaaacttaataaggaagtgaaagatctgtatgataagaacttcaagtctgtgaaaaaagaaattaaagaagacctcagaagatggagaaagacctcccaggctcatggattggcagaatcaatatagtaaaaatggctatcttgccaaaaggaatctacagattcaaggcaatccccatcaaaattccaactcaattcttcaacgaattagcaagggcaatctgcaaattcatctggattaagaaaaagcctagaacagcaaaaactcttctcaaggataaaagaacctctggtggaatcaccatgcctgacctaaagtggtactacagagcaattgtgataaaaactgcatggtactggtatagtgacagacaagtagaccaatggaacagaattgaagacccagaaatgaacccacacacctatgatcacttgatctttgacaagggagctaaaaccatccagtggaaaaaagaaagcatgttcaacaaatggtgctggcacaactggcggttaacatgtagaagatgcgaattgatccattcctatctccttgtactaaggtcaaatataagtggatcaaggaactccacataaaaccagagacaatgaaacttatagagaagaaagtgggagaaagcctcgaagatatgggcacagggaaaaaaaaatcctgaatagaacagcattggcttgtgctgtaagattgagaatcaacaaatgggacctcataaaattgcaaagattctgtaaggcaaaagacaccgtcaataagacaaaagggccaccaacagattgggaaaggatctttacctattctaaatcagatagggaactaatatccaatatatataaagaactcaagagggtggactccaaataatcaaataacttcattataaaatggggtgcagaccttaacaaagaattctcacctgaggaataccgaatggctgagaagcacctgaaaaaatgttcaacatccttaatcatcagggaaatgcaaatcaaaacaaccctgagattcaacctcacaccagttagaatggctaagatcaaaaattcaggtgacagcagatgctggcgaggatgtggaaaaagaggaacactcctccattgttggtgggattgcaagcttgtacaaccactctgaaaatcagtctgcttgttcctcagaaaattggacatagtactaccggaggatccagcaacacctctcctgggtatatatccagaaggtgttccaaccggtaagaaggacacatgcttcattatgttcatagcagccttatttataatagccagaagctggaaagaacccagacgcccctcaacagaggatggatacagaaaatgtggtacatttacacaatggagttctactcagctattaaaaagaatgaatttatgaaattcctaggcaaatggatggacctagagggcatcatcctgagtgaggtaacccaatcacaaaagaactggcacaatatgtactcagtgataagtggatattagcccagaaacttagaatacccaagatagaagatacaattggctaaacgcatgaaactcaagaagaatgaagaccaaagtgtggacactttgccccttcttagaattgggaacaaaacacccatggaaggagtaacagagacaaagttttgagctgagacgaaaggatggaccagctagagactgccatatccggggatccatcccataatcagcttccaaacgctgccaccattgcatacactagcaggattttgctgaaaggacccagatatggctgtctcttgtgagactatgcaaacacagaagtcgatgctcacattcaggtattggatgctgataaagggccccacagggcccccaatggaggagctagagaaagtacccaaggagctgaagggatctgcaatactataggtggaactatatgaacttagcagtacccccggagctcgtgtctctagctgcatatgaatcagaagatggcctagtgggccatcagtgtaaagagaggcccattggtcgtacaaattttatatgcctcagtacagggaaatgccagggccaaaaagtgggagtgggtgggagagcatgtgggggacttttgggatagcattggaaatgtaaatgaaataaatacccaatttaaaaaaattagaaatggagaaattataaactctcattaaacatctttatgttgtggcagtgttatagctaggcacattttattttaggcaacactcttcagtaccaccagccatttgttttcaactccagtaactttaagataagatcctgataatcctaattcagtaagcctcactcaaaagtgtaaagtcatcactatctagttattatatgactaactgattttttttttgcttctataactttcttgtgcagatacccaaagatgctttggattaccttaatcactagacagaacagcatagttttttttttttttttattgctgttgttgttggttgattggttggttggttttttgttgttgttgttgttttgttttgttttttgtttctttgtaagtataggtataatatatatacatatacatatacatatatatatttgcatatatactaatatatattcatatatgtatgttttctctcagctcaagcaatcaataaatgaaagcataacaattcatcgttactactctccatcatgggtctccagagagagaaaacagtacttaaaatatttgtgcccacgtaatcaagtatacttaatatggtcagtttaaaacatgcctaagccgggtgtggtggcacatgcctttaatctgagcattcaggaggcaggggcaggcggatttctgagtttgagtccagcttggtctacagagtgagttccaggacagccagagctatacagagaaaccctgtctcggggaaaaaaaatgcctggatcttcattggtgctctgattaaagttaattctcaggaagtcctagatacatctaggtgaaaggataagtagggtagtaataatacattttgctagttctttttttttttttttttttttttttttgcttttttgtgtcttcagagcctacttcaacctggcctacttaacaataactcattgatctacatgcattcttaatgacctgaaggtaaagagtttgtagattcagttcaaaataagcttctcaagtcacatgaaaagttgattactgaaaattaagcatttaatctgcactaaatctcagtagttaccaaaagctcctttctatagaaagagaagttattctcaaagaactacagagacttgatccaaaatccttagaaccaaactacaaatcactaggatcctgaaaaataaatgcacccaatggcattgctacctgcccctgacagttcaataccaatggattttttgactgatatagatcgatgggaacaggatattccatggcaacatggcaacttattaagactgacagagacctttcttatgttctgtgttctactcaaaggccttctatataattaaaataattttggcattgaaacttgattctctgtttcaaatttttctttttccaattttgcccagtgaaactggaatctaccttatacttgttggaatcagtaaaatagtataatatacctgtttactaattttattggtcatggcttactagagtaacagaattcatgaattaaatatataatattttatatagtattttttagttttatttatgtattttatgtatataagcacaccattgttctcttcagacacaccagaagatggcatcagatcccattacagatggttgtgagccaccatgtggttgctgggacttgaactaaggacctctggaagagtagtcagtactcttaactgctgaaccatctctccagctctgtggtattatttagaaggatttacaggctgtagtccaactaacccaataatagctctctatgaatggaaaatccaataatccagtagttgttcagtctattaggttggatttctcagctggccttttgtatataattagatcatgaagaaccaggattttatgctaattagtaatggacttgctagtcaggcaaaagcaagtaggcaaaaaccaaatcatccttcgatgtccttatacaggcttcctgtaggagatgtgtcccatattagaggcagatttcccaattaaattatctgttttaaagttctatttcagattttgattgacacattacattttagcatattattaatattatattataggcttcctaattatattaggcttccttaattatattattaattaatattataggcttcctgtatgagatgtgtcccatattagaggcagatttcccaattaaattatctgttttaaagttgtattttcacacctaaaatatccacattaaaggtgtgtttcccacctcaaatatccatattatattatataacattatattatatgcttcctaattatattaggcttccttaattatattattaattaatattataggcttcctgtaggagatgtgtcccatattagagacagatttcccaattaaattatctgttttaaagttgtattttcacacctaaaatatccacattaaaggtgtgtttcccacctcaaatatccatattaaaagtggaccttctttcttaaaagtaagcaaaaattattgaaatgtgtccccaaattttggtttttagttaattccagatgtagtcaaggtgtcaacaaagaatagctatcacatacataaaatattttcagattttgattgacacattacattttagcatattattattgtctttgtctgaaagactgcatatattcctgtttatatttgcatgtgtatgtgtaggtatacacatacatgcacataatgactataagtcaatctctataattttcctcctatacataataattttatattaatttaattcgaaaggggaaaataccatgagtttgaaaatcagagaacaattttcaggagttaatattctcattgtactgtgtgacttttagagaacatgttgagtttttaagctttgttgcatccagctttactaccttcatctttatagttccatccctttaaactccaaaacaagaatatcttacctaattccacagagatattcagttcaaactctaagaattttaaaatagtttaaagtgagattttattttgttgatatcctctgtatttcagatacttttcatgcactctaaagcatgattagatgtttggggtaagagtctgttgttaagcctgtacaaatactgtgctgtccacccacaacagttgcatgtatgactagaggactgtggtgagtcactagcacagccagaatggatggagtatgatgagtcaagtcagttgcagtaggtcctgctcagcaaaaggagagagtttcatccacttgaagaatggtgggcaaggcagcgcagacaccaagcacagtccccaaagccatcactgtatcttccatagatgggcataatttttgtaggttaaggatcacagatgttcagaattagaaccttgttgcattgatctaaaatctttgactctaaagaaccagatcagaaagctatcagatcagaacctggactcagttgcccctccctccatcatgttatctgcacagtgacccttctcttgatctgtcaatcactcctggtactttagctcagttctcttcctgatttgcaattgctcaatggttgggagaatcagaaaattttagttctgatgttttgatatttataataaaaaaagggatttccaaagtggctgtaagaaaagaaagaggtgaacacagtggactgctctctctctctctctctctctctctctctctctctctctctctctctctctctctcttcctctctgtctctctctctctctctttttttccattttttattaggtatttagctcatttacatttccaatgctataccaaaagtcccccatacccacccacccccactcccctacccacccactacccctttttggccctggcgttcccctgtactggggcatataaagtttgcgtgtccaatgggcctctctttccagtgatggccgactaggccatcttttgatacatatgcagctagagtcaagagctccggggtactggttagttcataatgttgttccacctatggggttgcagatccctttaactccttgggtactttctctagctcctccattggaagccctgtgatccatccattagctgactgtgagcatccacttctgtgtttgctaggccccggcatagtctcacaagagacagctacatctgggtcctttcgataaaatcttgctagtatatacaatggtgtcagcgtttggatgctgattatggggtggatccctggatatggcagtctctacatggtccatcctttcatctcagctccaaactttgtctttgtaactccttccatgggtgttttgttcccaattctaaggaggggcatagtgtccacatttcagtcttcattcttcttgagtttcatgtgtttagcaaattgtatcttatatcttgggtatcctaggttttgggctaatatccacttatcagtgagtacatattgtgtgagttcctttgtgaatgtgtcacctcactcaggatgatgccctccaggtccatccatttgcctaggaatttcataaattcattctttttaatagctgagtagtactccattgtgtagatgtaccacattttctgtatccattcctctgttgaggggcatctgggttctttccagcttctggctattattctctctctctttctatgtgtctctgtgtgtgtgtgtgtgtctttttctgtgttccacttgactataaaatatgaataaatacatcagtagaatgtctagtgtatagaaaggtgaggtgtgtgtcacatgcagggttactgtctatacagagatacaaaatgagacacatttttctatgatttgtaatgtctaattttaatgtggtttacatgcttctctgtatcatcatcttcttcttcctcttcttcttcttcttcttcttcttcttcttcttcttcttcttcttcttctttttcttcttcttcttcttcttcttcttcttcttcttcttcttcttcttcttcttcttcttcctcttcctcctcttcctcttcctcttcctcttcctcttcgcctccttctccttcttcctcgtcctctccttctcttcctcctcctctttccccttccccttccttgtcttcctcttcttccttttcttccttttaatagttatttacttttttaatgctgtttgaatccaaaatgatacttaaggtttttaaaacatttggtttggttttatcgtttgttttacattgctttctattagaaggtatacaaatggtgtgcaaaagttcattttaggcatcttttgacagataagacaacagggtgtctttttgttctcatattttattcctcctttcaaaaatgatattttgaatgtaaaagatatttccagactatagtgaagaggcagtgacccatgctagcaccattatcagtgtttctataggttgtcatttccccatagtagtcctgctaactaataccaaaatagcacagctcagcacagataagcacactcagctcagcacagatcagcaccaatcagcatagatcagcagagctcacaacaacagagaagggatggagatatatattttcctttcttttatgttttgtgtgtgtgtgtgtgtgtgtgtgtgtgtgtgtgtgtgtgtctgaactttcaactgcttacaactctatcccaatgttctactataaggaaaagaacaggcaatatctgcaggaagaaacatgctccctaggcaagggagtggtggctacaactctcttgccctggctctagcagttatcccttgtgcctacttccttgcagtgtttcagtggagacctgtaaaattatatggaactgtataagctgtgctaatgaagttgcaagcagactcttttccccaatactccagtaaaagaagatctaaactcaggaaataacaggagtctatgtagcttctatctacgtggcattccttattccacatgttgctgctttcttgtattatagtaaattagagtagtggatgtctgtagcaactttgcaagatgctgctttgtccgggtaatggtggttacaatatacttcatctgtttaatctactccttgttcctataaaggcaagaactcacaggattggctatgttgccttagacagtcttagttattcctatagatgttttatttaaactcatcaacctttttatacttactttgtcatccaaaatacttttaattaatttattttttacttattcattttacattcctgctcactgcccttctccaagccaccccctcccataatcctgccctcatccccctccctttctcctctgaactagagagcagataccctcaagggtatatccttggcactttaagtctctgtgaagataggcacttcctctcttactgaggtgaaacagggaagcccagctagaagaacataacccacatgcaggcaactgtgagactgtgataggtagcctattttggttgaataaggcttgctctggcaacccagtagaaaactctacaagggacagaaaactgagccatgttccgagagtcaggtgcctgacaccacagagcccccaactccatgattctgtgactataagtcacatagacaatgtcccaatcttctggcattctggacagactccacccccacagttacctgactatagccaggtatgccccccacctccccatagttacctggcaacagcaaaatagcccagcccactataaaaggggctgcttgggacctccttgctctctttaagctttcacctttcttactctcatctctagccctctctctctctctttcttctcccctctctccacatggctatgtctggcctctttccttaccttttccctttcccctgcctttctgcaataaagctctaaaaccatagactgtctctgctcatcaaggcccaccatgcttgaatgatgaaatagactttctcctaaagagcaccgtctaactgtctaacctcctgccaaaaggaattcctgcactccaaccatggacacgaccaaggattctcactcctgtgagaaccacacagtgcccctcctccctgcccactcctacctttggctccaggccttaccaagcctcctgagctgccaccagggcccacattctgttctcagctcttctgtggtgtccagtggtgtctgggatacccgaggctgagaacctggtacctagaactgccctttgtccactaccagctgagctggggtccagtggcttcccacaccagacacccatccagggccacatgaaaaatgtgcagcaatccttctgtatccacccacccagagcaccagtactctggcaggatgtgggttttctcccactcccctatttttcccacacccactgccccataggcaacagcctttggtatagcccttgctccaggtatttagaacccatatgaatatcatgctgcacaactgttacatctgtgtgaggggcctatatccagcccttgtatgtcctttgcttggggttcaatctttgagatcctccaatatttgaggttagttgattttattggtcttcctatgaagttactattccctgagggactacattccctcctcctattcttccataagagtcccccagttccatttattctttagctgtggttgtctgtatctttctttttttaagatttatttatttattatatgtgtgtacactgtagctgtcttcagacactccaaaacagggcatcagatttttgttatggatgtttgtgagccaccctgtggttgctgggatttgaactcaggacctttggaagagcagtcgatgctcttaaccactgttccatctcatcagccccctatatcttttggagtcagttgttggttgggcctctcagagaatagccatgccagatgcttgtttgcaagcataacagtgtatcaatgatagtgtaaaggattattgctttgtcatgggatgcatctcaatttggactagtttttgggtgattatttcctcagtttctactccatccctaatttgtgtatttcttgtagataggataagttttggatcaaaagttttttgggtgagtttttgcctgaggttccttcctggactacaaaggcagcctattcagactccatgtctggaatgctgtgagtcactgctcaggactaccattttgatacatggtcacttctgatcattaggtctccatcagttacttgagatgtcccctactttcctgctgtaggttacagatttccattcattctaatgactatttgaccatcccaccctccccctccccacaaagggacccatattcctccattcccctcatacttccctttcccacccaggttccttgatccatctgccttccagtatcatttcattcccccttccaagtgaggctcaagcatccttgcttcttcccttctttctgtccagcctcctggatctgtggagtgtggcatggtcattctgcattttatagctaataaccagcctctcgtgagtgaatatacactgtgcacatcatattaaaactgggttacctcaatcaggatgatattcacaaggtccatccatttgcctgcaaaattcatgatgtcttcattttttttaaagctaaataaagataaatgttccttattcattctttagtttagggatatctaggttacttcaagtgtctggctattacaaacaaagctgctatgaaaaaatatctttgtgcgatggtagaacatcttttgaatatatgcccaggagtgtggtatggctatgtcttgaggtatatctatttaccagttttctgagaaaagttccaagttgatttccaaaatggttgtacaaggttgcacttccagtagcaatataggagcagtcgtactagtcgacatcagtaagactagcaccatttgttgaagatgcttcatttggaggatcggggtggatatggttttggcttttttgtttacaattaaatttccatatgttttgggggtattttggggggattttgattctatttcattgatgaatatgttattttccccttgctccacatcctcaccagaatgtgctaaaacttcagtttttgatcaaccattctgaccaatggaagatgcaatctcagtgttgtcttgatttgcatttcactgatgactaaggactctgaacctttctttaagtgcttcttggctatttgagatttttactgttgagaacactgtgtttaactttgtgccctacttttcaattgggttatttggggtgtttgtgtttaacttcttgagttcttttggagattagcctcctgtcagaagtaaggttgttgaagatcctttctcagtctgcagactgccattttgtcttttttacagcatacttagctttacagaagctttacagtttcatgaggtcccatttatcaagcggtgatcttagagctagagccattggtgttctcttcagaagattgtctcctgcaccaatgcattcaaaagtatttctcactttctcttctatgagatttagtgtatctttttcatgttaaggtccttgatccatttggtcttgagttttgtgcaaggtgttaaatattgagctattttcattcttctacgtgcagacatcagtaagactagcaccatttgttgaagatgcttcatttggaggatcggggtggatatggttttggcttttttgtttacaattaaatttccatatgttttgggggtattttggggggattttgattctatttcattgatgaatatgttattttctgtaccataccatgcagttttatccctattgctctgagatacagcttgaggtcatgaattgtgattttgttcgaagttactttactgttcataattgttttgactatccttggtttattatttttccatatgatattgagaattattgatagagttttttatatattttttcaacatactagttcattttgcagacacctcctcccagcatgtttcttataattcaatatgtatcaagtgaattttgcttaaacaccacttatattttatggcttaatttttatagatacatttattaacttttctcttattcttttgatatcaaatgtcttgttccaaaagtcctgtcttagttcagtgagttgaaaggtactgagtaattacttctatatcagatttagggcatcaagtcttaggttacagtccttgatctatttgcagatgagttttggaggctaattaataaaggtctcatttaattctctatctgtagctatccagattaatcagcaccatttagtgaaaaatttttaaattgtgttcaacacagagatgactgtatcagtatggtattttacttgagtcttcatttctattcaattcatcaatggattatgttttataacatatattgtataggttttgacacttcagctgtgtagcacaatgtgaaatatgggattgtgataattccttctgttttattattcaggatttttgggtttgtgtttgtgtttgtgtttatgtttgggtttctgtttgtgtttgtgtttgggtttgggccaacataaaacttcttcccatataaaattacaattacatttttaatttcctctgaaggattgtattggagattacattgaatgtgtgatttgctttttgaaaaagagccatttgtaaagtaatagctctgttgtttcataaatgtgggggcactttagcctctaatttcttattcagttaacttttctagtttcttaaatagtcagtgtagctttttacattttgggttttgtgtgtgtgtgtgtttctctctctctctctctctctctctctctctctctctctctctctctctctctctctccccgtgtgtgtgtgtgtgtgtgtgtgtgtgtgtgttgggaattgcattgtttctatgatttcttacatacaaccttggttgtatatgaaacctgttgaattttttgtgttaaatttctatcatgtcacttttgctgggtgtatcagtagcaataggtttctggttgcaaattaaggatacattaaatatggaatcacatcacattcgtcattttaatatctgagtttcatatatatgtgtgtgtttcatatatatatgtgtgtgtgtatatatatatatatatatatatatatatatatataatctcacattttttctcttttgctctctttctggtgataagactcctaataatgtaattagtaagagagaaagagtgaacatccttgtctcattccaaagtattatccatttattacttttatccatttattacaattctggctttgaccttattatataatgtcactcttttttttttaattaggtatttatttcagttacatttccaatgctattgcaaaagtaccccacatgctaacccacccactcccccaccctcccactcccacttcttggccctggcattcccctgtactgaggcatgtaaagttggcatgaccaaaggacctctctttccactgatggccgattaggccatcttctgattcatatgcagctagagtcaagaactctggggtactggttagttcatatttttgttccacctagggttgcagatccctttagctccttggttactttctctagctactccaatgtgggacctgtgaaccatccaataactgactgtgagcatccacttctgtgtttgctaggccccggcatagtctcacaacagacatctatatgtgggtcctttcagcaaaatcttgctagtatatgcaaaggtgtcagcatttggaagctaattatggaatgaatccctggatatggcagtctctagatggtccatccttttgtctcagctccaacctttgtggctgtaacttgttccatggggattttgttcccaattctaagaaggggcaaagtgtccacactttggtcttcgttcttcttcagtttcatgtgttttgcaaattgtatcttatatcttgggtattctaagtttctgtgctaatattcacttatcagtgagtatacatcatgagttcttttgtgattgggttacctctttcaagatgatgccctccaggtccatccatttgcctaggaatttcataaattcattttttaatagctgagtagtactccattgtgtgaatgtaccacattttctgtatccattcctctgttgaggggcatctgggttctttccagcttctggctattataaacaaggctgctatgaacatagtggagcatgtgtccttattaccagttggaacatcttctgggtatatgcccaggagaggtattgctggatcctttggtagtactatgtccaattttctgaggaaccgccagactgatttccagagtggttgtacaagcttgcaatcccaccaaaagtggacgagtgttcctctttctccacatccttgccagcttctgctatcacctgaatttttgatcttagccattctgactggtgtgaggtggaatctcagagttgttttgatttgcatttccctgatgattaaggatgttgaacattttttcaggtgcttctcagccattcggtattcctcgggtgagaattctttgtttatctctgagccccatttataaatggggttattggattttctggagtccaccttcttcaattctttatatatattggatattagtcctttatctgatttagaataggtaaagatcttttcccactctgttggtggcctttttgtcttattgtcgatgtcttttgccttacagaagctttgcaattttatgaggtcccatttgtcggttctcgatcttacagcacaagccattgctgttctattcaggaaattttcccctgtacccatatcttcgagggttttcccgactttctcctctataagtttcagtgtctctggttttatgtggagttccttaatccacttagatttgaccttagtacaaggagataggaatggatcaattgacattcttctacatgataaccgccagttgtaccagcaccatttgttgaagatgctctcttttttccactgaataatttttgctcccttgtcaaatatcaagtgatcataggtgtgtgggttcattcctgggtcttcaattctattccattggtttacttttctgttgctataccaataccatgcaatttctattacaattgctctgtactaccactttaggtcaggcatggtgattccaccagaggttcttttatccttgagaagatcttttgttgtcctaggttttttgttattccagatgaatttccagattgccctttctaattcgttgaagaattgagttggaaatttgatggggattgcattgaatctatagattgcttttggcaagatagccatttttactaaattgattctgccaatccatgagtctgggaggtctttccatcttctgagatcatctttaatttcttttttcagaaacttgaagttcttattatacagatctttcacttccttagttagagtcacagcaaggtattttatatcatttgtgactattgagaaaggtgttgtttccctgatttctttctcagcctgtttatcctttgtgtacagaaaggccattgatttgagtttattttatatacagctgcttcattgaagctgtttatcaggtttaggagttctctggtgtaatttttagggtcacttatatatactatcatatcatctgcaaaaaagtgatattttgacttcttcctttccaattcctatccccttgacctccttttgttgtcaaattgctctggctaggacttcaaatacgatgttgagtaggtagggagaaagtgggcagctttgtctaatccctgattttggtggaattgcttccagcttctcaccatttactttgatgttggctactggtttgctgtagattgcttttatcatgtttaggtatgggccttgaattcctgatctttccaagacttttatcatgaatgggtgttggattttctcaaatgctttctccacatctaacatggttatcatgtggtttttgtctttgagtttgtttatatactggattacctggaaagatttccttatattgaaccatccctgcatccctgggatgaaacctacttggtcacgatggatgaatgctttgatgtgttcttggattcagttagcaagaaatttattgaggatttttgcatggatattcataagggaaattggtctgaagttctctatcattttttgggtctttttgtggtttaggtatcagagtaattgtggcttcatagaatgagttgggtagagtaccttctgcttctattttgtgcaatagtttgtgaagaactgggattagatcttctttgaaggtctgttagaaatctgcactaaacccatcttttttttttggttgggagactataaaggactgcttctattactttaggggatatgggaccatttagatcattaacctgatcttgatttaactttggtacctggcatctgtctagaaacttgtccatttcatccaggttctccagttttgttgagtatagccttttgtagaaggatctgatggtgttttggatttcttcaggatctgttgttatgtctcccttttcatttctgattttgttaattaggatgctttccctgtgccctctagtgaatctggctaagggtttatctatcttgttgattttctcaaagaaccagctcctcgatttggatgattctttgaatagttcttgtttccactaggttgattttgcccctgagtttgattatttcctgctctctactcctcttgagtgaatttactttcttttcttctagagcttttaggtgtgttgtcaagctgctagtgtgagctctctctagtttctttttggaggcactaaggactatgaggttccctcttagaaatgctttcattgcgtcccatacgtttgggtatgtcgtggcttcattttcattaaactccaaaaagtccttaatttctttgtttattccttccttgaccaaggtatcagtgagaatagtgttgttcagtttccacgtgaatgttgggtttctattatttattttgttattgaagatcagccttagtccatggtgatctgataggatgcattggacaatttcaatatttttgtatctgttgaggcttgttttgtaactaattatgtggtcaattttggagaaggtaccatgaggtgctgagaaaaagttatatccttttgttttaggataaaatgttttgtagatatctgttagatccttttgtttcataacttctgttagtttcactgtatccctgtttagtttctgtgtccatgatctgtccattggtgaaagtggtttgttgaagtctcctactattattgtgtgaggtgcaatgtatgctttgagctttactaaagtgtctttaatgaatgtggctgcccttgtatttggagcatagatattcagaattgagagttcctcttggaagattttacctttgatgagtatgaagtgcccctccttgtattttttgataactgtgggttgaagtcgattttattagatattagaatggctactccagcttatttcttcagacaatttgcttggaaaattgttttccagcctttcattctgaggtagtgtctgcctttttccctgagatgtgtttcctgtaagcagcaacatgttgggtcctgtttgtgtagccagtctgttagtctatgtctttttattggggatttgagtccattgatattaagagatagtaaggaaaagtaatagttgcctcctattatttttgttgttaaagttggcattctgttcttgtggctttcttcttttaggtttgttgagggattaccttcttgctttttctaggatgtggtttctgtccttgtgttgggttttttttttttcctgttatccttcaaagggctggattcgtggaaagataatgtgtgaatttgattctgtcatggaatacttttgtttctccatctaaggtaattgaaagtttgactggctatagtagcctgggctggcatttgtgttctcttagtgcctttataacatctgtccaggcttttctggctttcataatctctggtgaaaaatctggtgtaattctgataggcttgcctttatatgttacttgacctttttcccttactgcttttaatattctctctttatttagtacatttgttgttctgattattatgtttcgggaggaatttcttttctggtccagtctatttggagttctgtaggcttcttgtatgttcatgggcatctctttctttaggtttgggaagtttccttctataattttgttgaagatatttactgtccctttgagttgaaaatcttcgttctcatctactcctattatccataggtttggtcatctcattgtgtcctggatttcctggatgttttgagttaggatctttttgaattgtccattttctttgattgttttgccaaagttctctatggaatcttctgcacctgatattctctcttccatctcttgtattctgttgctgatgctcgcatctatgttttcagatttctttcctagggtttctatctccagcgttgcctcactttgggttttctttactatgtctacttccatttttaggtcttggatggttttattcaattccatcacctgtttggtcttgtcttcctgcaattctttaagggatttttgtgcttcctctttaagttcttctacctgtttagcagtgttctcctgtatttctttaagtgagttattaaagtccttcttgatgtcctctaccatcatcatgagatatacttttaaatccaggtttagcttttcaggtgtgttggggtgccctggactgggcgaggggggagtactgggttctggtgatggtgagtggtcttggtttctcttagtaagatttttacatttgccttttgccatctggtaatctctgtagttagttgttatagtttctctggttagagattgttcctctcatgattctgttagcctctatcagcagaccttggatactagatctttcctctgaatttcagtggtcagagcactctctacaggcaagctatcctcttacagggaaggtgcacagatatctggtgttcagacctccctcctggctgaagatgaaggcccaaaacagaacctgtcacagaagctgtgttgcttaggcctgcacagaagctgtttgcttctgtagaccacactctcacctgcacagactagtctcacaggtatccaggaaccaagatggctcccgtaggtgctcctgcaaagccctcccgggctggactgacacctatcttctggcagggaaggtgcccggatgtctggagccttaaaagggggctgcctcagaagctctgtggcttctgcctgtcccagaagctgttagcttctgtagtccacactctcacctgtgcagagtagtctcggtggagtcctggaaccataatgtcactctttagtcaaaatatgttctctgtatttttaccagtggtcacatttttttttttaaagtgacacttcctcacctagcaaacatcaatgctaatggtcccccaggtatattactgaactataaatgagtactcttttcctgtacttggatttttttagtgaattttttgtttatgcattgactaatattgaatgcaacatgaatcatgtctaaccaaaccctgagaacagcaaatattgatagactactgtgacaatctactggttctcaaaaatttttaatgtataaatacatatttatacatatttatttacaaactttttaagatgacaaactaaaattacagagacttaatttgacttcagtacatgttccaacactaaagtatttacataaactagtattgccacgttataaacaaaattccatgatttctgaatttcattcacttctcactacaacctcaagtgaagtatcttcatcttttttcataagttgtaatttcttctatattccttacattatatcccaaatctaacaagtaaagtacttttggtttgtttgctttgtttctatattaggagtggttacttgttattttggatttgtttgcttattttatttattatgtagaaaaaactggggaacacctaaattctatcttaaaatctccacacatttacaatcatagtggaaacaaaaaacatgagtattaaaattatttgaggaaatggacttaatgttagagattttaaattaaaaatgattttttctacaataataaacctgattacagtcattttccctctactagtcctagtccctgcccacatacatttctgttattacaaaacttttctaagggctaaaaacaaagtaaaataaaaataagaaattgtcctaacataaagcaaatactaacacaatggaaatggacaaaacaacaagaaagaaaagattccaagaaaagtgcacaagaagaatgacacagtagctcacatattcaggaattctatagtaatgctaaaatggaagccatattatatgcagaggacaaagtgcagacactcagagttcatatgatctcagattatattgtttaagaaccccttattttcttggtgttccccatgtgttctggctagtacacttgttttgcctcctctttttcatggttaccttagcactgaatggatgaatttggtggagtcagtaagtttaggggtgaatgtcccaaaaactctcactctatgtataatgtataaatgcaggtctctgtatttgtttctaactcatgtagtagcccttaagacaaattagatattgcttggtcattaccacatgctttgtatcaactttgaagtagcatatctttcaggcaggatatactattttagatcaaaggatttgtgtattgcttagtgtgtgtatatctatttcagtaatgtgtagactactataggcacctacacatatgctcacatacacatacacacagaagggtgagagaacagagagacagatgctgagtgatagacagagacagaaatggggacaaagatagaaatatacacacatgaataaaattaataaaatctagctaactgtggtgacacatgactttccttccagcactttagaggcagaagctggtaaatctctgcattcaaagccagcccagtctacaaagtgtctttccagtccagctaattctaatgagtaagaccctcattagagggtcaagaaaaagaagaaagaagaaaagagaaagaaacagacataagtatctcctagcaacaatttttaaaatgagagaaaaaaattcatcacaatgaaaatcaatattgttattaaacaacaaataatatgttcataagggtttcatttacatgaacacataggaaaatttaaaagtacacctaatcaagtaaaacctgattaatgcagaacgttgttaaaggtagcatcttttaatctttagtgatttctcctgatagtactataagtatctagtgcttttgtaaattccatagtttgggttacatttttcctaagcactctttcttttctttgtatagaaatcaaatggtgaatataaatcaatattgtgtagtcaccattgcccacaaaacaccttgaatttattcctgaacaatttatataggggtttttgaagaccttcctctttcatattagcgataggagagctgacagctcatggttgcctgcattatgtcatttgctttagaaaagattttgaatccctgcagcctggcaaacatgcacgcatgcgtcgttgaaggtgtgctagctcaatagcacaaactgggggttgggtgtgtgattagtcaagtcagtgcagcaggtcctgctcagagaagaggcagccaaaggagcctgacacatccaccctaggagttgtcagcaaggcaatgcagcaaccaaggtcagctctcatagctccctcatttctttcatagttagtcatgtttcttttcacattaagtattgcaaatttgttggaattagaacattattctatagatctcaattctttgactttgatgaatcagatgagaatgctatcagatcaggaacgggcttcctttgtcttgtcctgtgttgtgttggctgcagtgcccctcccttgagccttcaatctgccctgtcacttcagttcagttctcttgcagggtgaacattaacatttcaaaaagctgacagtattgtggattattggtgtgtgggagtaatggcagccatattaaaaaaaaagaacatttgtttttatacgtggatgttgcataaaaatagcattcataagggaacttaaattggtatcttgctgtctgccatgaactgaaggatgtaaggggataaaagcatttgtgagttaacatacagattatcagcagagggaagactcaacaaaccattgtgttttgcacttcccagtttctgaatggctaggagagaatcagagaaatatgagttttgatgctgtgatacttataaaagaaaggggttttcaaactggctttaagaaagagtattggacagagagaattcagatgtgtaaagtgctaacttgtagaaacatggggtgtctttacatacagatacagtggtacagaataataaaccttttttttttctgtgatttcgtaaggtggtatggtttgtctattttgatagtgcttcactgttttaggatatgtgttgttagtatgtttttatttgaaatcttgcccagattcaacaataaacttgtagattagaaagaactttctttgaatatgtgatctatattttgatcccctgatttggatgaggtttgtaagatatgcaaaatagcctgtagattttttttttttttttttttttttttttttgccatcctccattagataaatccggaagggtctgtcttgtcacttgttatttttttgttgttgtttggttttgttttggggtctatttggaattgcattgtgtttttcattacaaaatggtatattttatgaaaataaatttttcctaatttttcatttccattcataatttttgtatttatatcatgattacagttttccttttttttactcttcccagttcctccccaacttccctccctttgagatctgctctttctgtatctcactagtaaagcacacccaagagataacaaccaaacattaacaaaataaaatagactaagataaacaaaactatcacattgagacaaggcaatccaacagaaagtaaagtccacagtagtgtcacaagaataagaaacccacttgttaactcaggaatgccataaaaacactaaactgaatattataacatatatacagaagacccagtgcagactgtggtaggttctggaacacagagatctacagagacatgaactttgctttttgtcattgtattttgtttttcatttcagaatgttgtttggttttaagatttttaaggtatttctaaagtgcaagcctgtgttgacccaagccaacagcttggtgaaggttgttgcttctgaagaggtgttaattaatacagatataaaagagtagcaccatataatacaattttgatacttcagttattatataggataaattgaaatctggcatgctgatacctcctgaattccatttataagtcatgttttttttctacagtgagtcttttttgtctccatataattttatgactatatttcttatttttttacaattaaatttcttaatttgtgtgaaggatattattggtgattatatatatatatatatatatatatatatatatatatatatatataatattttatggaacatgttggtgttatatattatacataacagtattatatataatattatataatacatattttacaaatgatattgtttctatggtttgtccctataaatatttgttattttaggatatgatttttttattaatttgtttatactgctgctttgctgaaagtaattatcagcattatgaggtttctgatggcacatttaggacattttgtgtgtagaatcatatcaaattcaagtgaaaatacattgacttcttcctttcaaacttgtatctccttgctgtctttcattcctgttgctttcctaagtcttctaaagctgtactgaataagacagaaaggataaatgtccttatcttgtatctgattttaatgaagatgctttgagttctctccgtctagcatgatgctggctctgagtttgttgtgtgtagttttatcattctgaaatatgttctgtttatccttaccagtgaccacatttctaaggaaacaggacacttgctaccctagtagccatctatgtcaataagaatgtgtgtgggtagggttggaatattgagaagccctccttctttcttacttgaatttgtgctcaatcttgtgagggatacacatgtaaccctaactgtaagaagccatgttatagagacattccatagcatttctccatgtcctctagcatttatttagtttccacaaccctttttttaagtattgcttgaccacaatatggggagttttagatgtcaaaatagacaacccagtcctggtactggactatctatctgttattctatagtgtccagtggagaaattcattgtcttgttactagttaaccatatttgaaaaaaaaaatatatatatatagtaaagcctctcttacagtagtttgcttccacatgactttttcaaaataactttaggaatatttatccttcctcacaatcactcctcaaatgtcagctttgattcctctcccctcagtgtgatggttccctcagggaatggcactattagaaggactatgagcgtggactttaatacccttgtcctagctacctggaagccagtcttctgttagctgccttcagaacaagaggtgaaactctcaactcctgcagccctacgtctgcctggactctgtcatgttcctaccttgatgaaaacagagtgaacctcttaacctgtaagccagtcccaattaaatgtcagccttattagagttgccttggtcatggtttctgttcatatcagtaaaaccctaactaagatatttagtctgtgccattagtttcccttaatatttataccattgttttctaaacacttccctcccactaaatacagatctatgatgttattactttcctgatctatatatttattctaactagaacatatatatatatatatatatatatatatatatatatatatatatatatctgtcattggaatttatgaaactggtgctctacagatgggaaagtaccatatcatgtttcaattagtggacagacttaaaagacaggtagattctggagcaggggggaaattgagccgatagcttaatatctatatttatttaccataacttaatttcataatatctataaatgataacacagcttaggaatgaggagagaattagatttcctcacaatattgtgagaaaactctcagtaatgcatttcgacatctctgtctctatatgaagtttttctttatactgtcagtaatttccaactagacctaggacttgtatggtatgttccatgtaaccatgttttatacatttgtatcacagatgatgaaattacttctctgatctagataggaatacatatctctggcctgttgcactcaaccttccacttgtagacacagatgtttcatttcctatatactctgaaggagatagagtttttaaagtgtttttgatcaagataaacactttaaaagaccatactgagagggaaggttaatactagtaattaagattggcattttagcttccagtttctgtctgcgacctggaattgaccctgtgccacaactctctatactgaaatcccaccatgagagagctgttatctcaggagtgctgacacacttgagagcacaggtaataccaccacttctactcagggaactgcttggagccctcaggacacaggaaccaaggagtaccctgagacaggatctttctggtttctatctgagactggacctgaccctgtgccacagatttaatactcaaatctcatggccaggagagagctggtccccaaggagtgctgatacagagccttacaggagggacaagccacagtcatagacagcaagacaagctaacacaacagataaccatatgtcaagaggcaagtgcaagaacataaacaacagaaaccaaagttatttggcatcatcagaatccagatcttccaccacaagcaagccctggataccccaacatatcagaaaagcaagactctgatttaaaatcacttcttatgatgatgatagagggctttaagaaggacatatatgactcccttaaagaaacacaggagaacacaggtaaatcccttaaagaggaaacataaaatcccttaaatatttacaggaaaacacaaccaaccaggtgaaggaattgaacaaaatcatccaggatctagtaatggaaatagaaacaatgaagaaatcacaaagggagacaaacctggagatacaaaaccaaggaaagggatcagtagtcatagacacaagcatcaccagatagaagaatataaatattgacataacagtcaaagaaaatgcaaaatgcaataagctcctaacccaaaacatccaggaaatccaggacacaatgagaagataataggcatagaagagagtaaagaatcccaacttaaagggccagtaattatcttcaagataattatagaagaaaacttttctaatctaagaaaaagatgcccataaacatacaaaaggcctacagaactccaaatgtattgtaccaaaaaagaaattcctcctgtcacataatagtcaaaataccaagtgcacaaaacaaagaaagaatattaaaatcaataaggggaaaaggtcaagtaacatataaaggcagatctatcagaattacactcgtgagaaatacatctcaccagagactgtaaaagctcaaagatgctgggcaaatgtcatacagaccctaaacaaacacaaatgccagcctaggctactatacccagcaaaactctcaattaccatagattgagataccaagatattccatgacaaaaccaaatttatacaatatctctctacaaatctagccgtacaaaggataatagatacaaacctccaacacaagggaaactatacccaagaaaaagcaagaaattaatcttctttttaaaaaaatgcaaaaagaaacagccatacaaacataattccacctttaataagaaaaataacaggaagtagcagtcactattccttaatatctcttaaaatcaatggactcaattccccaataaaaagacatagattaacagactagataggtaaacaggacccagtattttgctacattcaggatctttaccaatcctacatccaatagagtgctaatatccaatatatacaaataactcaagaaggtagattccagagaaccaaataacactatcagaaaatggggttcagagataaacagagaattctcagttgaagaaactcgaatggccaagaagctcctaaagaaatggtctacgtccttagtcatcagggaaatacaaatcaaaatgaccctgagattccacctcacaccagtcagaatggctaagatcaaaaactcaggggaaggtgcatcatctctgaatgaacacagacccagaagtcctcgactgtatgtgtgttgggggcctcatatcagctggtgtatgctgtctgtttgatggtccagtgtttgagagatctctggggtccagattaactgagactgctggttttcctacaggattgcccttctccttggcttcttttagccttccctaattcagaaacaggggttagctgcttctgtccatttggtggatacaaatatctgcatctgactctttcagctgcttgttgggtgtttcagtcataataggtccctttttataagcactctatatcctcagtaatagtgtaagaccttgggacctccccttaagctggatcccactttggacctattatccttgggctcctctccatttccttcctgtagcccgagggagtttagagatcagatggggtgggaggtgggggcagccatgtgaagacagaggggtggggaggaggggttggatgtagagcagttggagagtgaattgggggggggcaggaaatagaatatggagtgtaaaaagtacattaatttaaaaaaataaaaaaaaacacagcaataaaaatgggataaacatggctaaacacacatggaaaatatcagaaaggaaacttttaagtaccagtgttgtatataatttagttgcaataattgggaaaaatcttaaaacaaacaaacaaaaactcaggggaaagcagatgctggcaaggatgtggaaaaagaggaacattcctccattcttgatgggattgcaagctggtataaccaatcgggaaagcagtctggcagttcttcagaaagtacctgaagacccagatataccactcctgggcacatacccagaagatattccaacatgtaataaggacacatgttccactatgttcacagaagccatatttataatagccagaagctggaaacaacccagatgcccctcaatagaggggtggatacagaaaatgtgatagatttacacaatagagtactgctcagctatcaaaaacaatgacttcacaaaattcacagggaaatggatggatgtagaaaatatctttagtgaggtaactcagtcacaaaagaacacacacaatatttactcattgacaagtggatattaggccaagcacatggaatacccacaatataactcatggaccacataaagctcaagaggaaggaatgtcaaattgtggatgcttcagtcctacttagaagggagggacatgggaagaagagagaagggagaggggaaaaagaggggcagaatcgggtatgggaggagatggaggagatgtacagagggtcaggaatttaaacagaggtctggctgggcagtggtgtagcacgcctttaattctagcacttgggagacagaagcaggcagatttcagattttaaggccagcctggtctacagaatgaattccaggacagccaaggctatacagagaaaccctgtctcgaaaaacaaaaaaataaaaataaataaaaataaatgaataaaaagctttaaacagaggtgtgtagcaatggggaactaggagtagcaaccagaaagtcccagatgccaggaaagcaagagcctcccaaaagccaatggggatgacattagctgaaatacccccaaaaggggcaggagaacctatcagaccatatgcagaagttaggtatgtctccttggttgaggaatggtgtcactcgcccatctcaaaattttaacccaggattgttcctgtcgaaaggcaatacagtgacaaagagtgaagcagaaactgaagaaaggacatccagagactgccccacctatgaatccatatcacatgcagacaccaaacaagacactattgctgatgccaagaagtgtttgcttataggagcctgatacagctgtctcctgagaagctctgccagagcctgaaaaatacagatgtgaatgctcacagccaactattgatctgagcatagggaccccaatggaggagttaggggaaggacttacagagctgaaggaaccttatctgtcatcaatgggagggaaggcccttggtcctgtgaaggtttgatgccccagtgtagaagaatgctagggcggtgaggcagaagtgggtgggtgggtgggtgagcaccctcatagaagtagggtaagagggatagaatagggagtttacagaggggaaactgggaaaggggataacattctaaatgtaaacaaataaaatatccaattaaaaaaaaaagattggcattttaaaatcctgtattgtgccctgggtgatgactcgttatttaagagcactgagcactcttcccaaatacctatattcagtttccagaactcacataactacaaaaacctgtgactccatttcccaggaatctgaagaattattctaacagcctcaggctcggtgcacaagtgctgaacagacatacatatagacaaacattaatacataaacttaaaaaataaataaaatctaaaacaaagaatgtgtctatttaattgtcctgttataaagagaatttgggtctacttggaaaaaaatccctttgaaaaactgatgacaaactttaaatttatcacttcaataaattctgacattgtggaaagtcaaaaatatgttaatgtatatgttttgtgtcatatctttatgataaaaaggaattcctgattatatatgctgccccatttcactccccattgtattggtctttccaatttgcctgaggaagttgatcctggtctagcattgaaaacagtgacaaaggtgaaggagaagcaggttaagagtcaagagaacatggccctgagtgttgcctaattagagctaagaacaactcaaatgaaccatagtatgaattcaggttatcaataggaaagcagattctaatatgataggggctagatatctgcccagctatttgctgataaaggtttattgtgaatataaaggctgtgggtgtggttttttgtttgttttgttttttgtttgtttgtttgtttgtttgtttatctaggaactcaattaccaaaggcagagtagaaaccctggactgagaattaaatgtcttctacaacaaagaactttctccacttcatttcaaacaaggactgaggtaacagctctatatactgacttaatatagtctatcactatttttttttttgagacagggtttctctgtgtagccctggctgtcctggaactcactctgtagaccaggctggcctcgaactcagaaattgaaatccacctgcctctgcctcccaaatgctgggattaaagtcgtgtgccaccattgcctgacttagaactccatccttaaaaacagaacagggatattaaactgcacatccatggcaacgaatcctggagagcatttatcatacacaggtacagaatactctcattgtgtattagagaaaggacaacaatatatctgcctttgaagaaatgaacaaagacagaatatttcacctaaacatttttttctaaagtatttttagacttacatattttatatgtgcaattttcttggctacatgtatgtttatgtactacatatgggctttgtgcccattgaattcagaaacaggtgttcaatccctgtaatgagaggtatgaactattgtaaaccatgatatgtgtaccaggacccaaattcatactctttgcaacaagaacaaatgctctgaaccactgaatcatggatttttataggctcctggtaaattatccagaaacaaatcatcatataaatgtgggcatgatattgacttgatgaagaaaacattttttgtgtataggtccttctgttttgagagccattttctatgccttttaaggattcttgaattatcaatcatagtgttggtggtttttatcattctgatttgaagctttttctcacaaaaatcatcaccatcttcattgtcatcatcattattatcatcagctagtttacgtattttcatttaaccttcctacctcttttgggaaaatagtacttacagacatacttaagggtattaaactcctcacatcttattctgtatttttttcacagctactatatgttctccacttacatgcacagttcttgaacaataatccaatctgaaaatagaaggtaatataattccaaagcccacaaggaaacttgaatgtacatattttcctatatgccaggattactataattggactgacttccttctttgttatctctgtgtcttaaggtttctattgatgcaacaaaaacaccacgaccaaaaagcaattggggaaaagggggtttaatttaacctacacttccacattgctgttcatcatcaaaggaagtcactactgagcaaggaattggatgcaggaccatggagaatggctgcttactgactagcttcaccagatttgctcagcctgctttcttataaaacccatgactaccatctccatgaggttattaatcagaatgtgctgggccctcactcactgggtccttatagctgtgtccttataccttatagctgggtctcatgaaagcatttcctccactgaggctccctctcctctaatgattttgtgtcaaattgacacacaaaaccagctggtacaactaacccgttattcacttgacgcacaagcacatcactatcaaggcacaattttccctttcttattcacccccaagatctcacattaagaacataaataattttagaagtctcacaatctttacaaattcaagcccagtaaaatttcagttcctttaaatcatccaatctcttttaaaacccgaagtcttttcaaatttaaaatttcagttgtgggctccagtataatacttagtctttcataggctctcttcctcatgtcaaactttttctttgcatgaccccctcagtcctgggcttcaagtgtgactcaggattcaccttcatcactggtctctcctagccccgtacagttccaagtcttagctgctcttcatggcaacttcatgccttcaaaaccagtactgccagggtgtttcttacagattacgaagtctaactgacatgacatacagtccaactgacatagaactttggctacctctggaacacagcttctctatgctttcaggaaatgatgttgttctcttctttttttttaattctttttttattagatattttcttcatttacatttcaaagactatcctgaaagtctcctatacctccccggccctgctccccaacccacccactccaaagcccatacataaacataataagaacaatatacagcaaaccaatagccaacatcaaactaaatggagagaaacttgaagcaaacccactaaaatcaggtactagacaaggctacccactttctccctacctattcaatatagtacttgaagtccttttcttgatcaatcaactataattcttagctgcagctaaccaggatcaattgctttagtaacacaagtgtttcctttcagtgttgctggtttcctgttaatcatgtctggccctttagctccaactcaccagaatgacagtctcaattcaaaatggtaaactgttctgatatactctttacatttcactcaaagttgacaagttagacctccatcttctgcactccttttaacattcttgtctttcaagctcaagaaccttccactgagctctcagcactcaaaggcttttgtatcccaaatctccaaagtcttttctcaatcctcctcataacatgttcatctctgtcacacaataccccacaatcctagtaactacttctctccttagatggggatttagcctccagcaggctccactccaaatgctcctgatgatcttggtggtaaagagacaacataaccatggcaacacttataaaatcaaacatttaattagggctggtttgctgttcctatgtttatcccattattgtcatggcagaaggcatggtggcatgcaggcagatatggatctgcaaaagagttcaacatcatgaactacatgcagaaggaagtgaagtggctgagcccttaaagctaaccctcgccgggcggtggtggcacacgcctttaatcccagcacttgggaggcagaggcaggcagatttttgagttcgaggccagcctggtctacaaagtgagttccaggacagccagggctattcagagaaaccctatctcaaaaacaaaacaaaacaaaaacaaacaaacaaacaaacaaagctaaccctcacagtaacacatgaccttcaacaaggtcacacctactccaacaaggtcacacctactaataatgtaattccctatggaccaagcattcaagtacatgaatctatgggagccattcctaatcaattcaccttactctgcttcaacaatatgttcttttgctgcagccctgaaagtgatcactcttggatggtattcattttcatcattagcattttaaagtgataaccttttctgtgctttaatgtaacacaaaatgcctggcagtggaattgaatccctttaatactagctcttgggagacaaagcaggagggtctctatgagttcaaggccagttttgtctacagacgcagattcaggtcagctcgtgctacacagaacactcttgtgtggtggtttgaatgaatgattggcccacagagattggcattgttaaaaggtatggcattgtttgaagaagtgtgtcactgtggggacaagctttgaagtttcctgtggtcaagcacagtgtgacacatagtcaccttctgtttcccacacatctagacttgtcagatgaaagaattttcagcttgatttctaacaacttgctggcaggctgccaagtttcccaccatgatgacaatgaactaaacctgctacatgccagccatgattaaatgtttctattataatagttgtagtggtactggtcagtcttctcagcaataaaacaccttttcttgaaaaaaaaaagttttaagttttcagtgattatgtccatagctatatagtcttcagtgatatgcaggcctataaaggtagtttaaataaaggaagcttggatgatgtaacttccagccagtcattagaacagacacgtgacatactcacagaggatttttgtattattttttaaaattgtgtattgtgggccacccaaaaactgaagaaggatttgttgcctgactataggccctgatcctctaactgggctgccaaatttgccctcagtggcagaagatgtgcctcaacctgcagaggcataatgtactagagtgtgttggtatccagggattgattgacccttctcagaggggaaggaagagggagataggcagatggactatgtgaggggaaatgtggaggtgggctgaaatatgggtgtaaagtgaatgaataaattgatcaatggaaaaagaatcctgtattaataactgaaaaagcagtcagttacattaccatcaccaaagttattgctaccctaataatcaaatattctctctgtattattgtatttcacactgtttcactcagcaaattttatgtatcacttacttatctaaagtatttccatactgccttaataagtagcaagatgaaatcatttattctttatgtactaatgattgccatgtttcctcatttgagatatatttaaaatttttctcacatttatttattcattgttcatatatctgtattgatgggtggcatgcatgacataaagaatgaaaagagtttaggaatactttgagagagttaggcatctccttctactatgtgacttctgggtattaaactcagatcacagaagcaaatttttagaagcaagcacctgtactttctatgccatctttccatcttggtcatactattttttacatcacttcttgtgatattctctcccttattcattctctctctctctctctctctctctctgtttgtgtgtaacaataataattatagaagtgattagagggggagtagagggcattggaggtgtaagaaagtgaagaaggaagcatggaatgatgtcaacaaagtagatttatatgaaataatcagaaaaagaaaacatctatgtaaaatgaatttgaaaagaaaaaaatgattcagcattttatgaatatagctttttttagatgaagaaagaaatgtaagactgtctttagaattttacatttcctgttagtgttgaaatgtaaacagaaaacctctctcttgtttcaggagaccctgtgttcctcactttacgatgggatgaaaaacatcactttatcgtttctttttgctgaagcagcaaaatggccatattctatccatctcagttttgtccttaaatatatgaatatttccaagggtcactttgaacataaattttaaaaaaaaaatcactttccacatgttcccttatcatcagtttcacttttcttcccttgactctcctctggtcaatgttttgtttattatatggagagaagggtaggcagaggacaaggagaaatattgaatgtatatatgacagtttggataggaagcttctaaacagcgagcctgttctgcattaacaaagataagcactattcagtctgtagtacacgtgcatagacttacatgaatgcttgcacaattcacggatataaaaaacttgtccccactaccttctatatacaattacaattaacaagaagagatttaactgctttttttctgagagcggtcactgtctctatgatgactagaagtcctgaatgtttgagctggagggattggaggaaataaagggcagaatctggattggtctgcacactctgagttcccttttcaatatatattcttttcaaagaaaaatatatatttcttttatgtatatgaataccagaagagaacatcaattccattatatatagttgtgagctaccatgtggttgttgggaattgaactcaggacctctagaagaacagtcagtgctcttaaccactgagcaatctctccaacccctcaatatatattcttaaatggaggatttataaaaatctttctctctactacattactcatttctgttttttcctggatgtttatcaccaacttagaagaaataatataattataatcttttgtttttgtttttgtttttttgagacagagtttctctgtgtagccctggctgtcctggaactcactctgtaaaccaggctggccttgaactcagaaatctgccacctctgcttctcaagtgctgagattataggcatgtgccaccactgcccagcagaattataatttttaaatattaaaatttacaatccaaagcaaatgttaaataaagtcatgttgaacattcagaacttcatgaaagtacatatatttcatgaaattaaaaggggaacttgttggaaataagtatttccatgggagaaggtatggagattagaaagtgtaactggatgtatgtgactaaagttcattatgtttatgtatatatctgtcaaaaataaaaaataaaataaaaaaaaccaatgcctcagtagacaaaggtgattgctattctagccccggcaatttgagtttgatctctagaatatatatacacatgcacatatagtgaactggctccccaaatttttcctctgacctttacatgtgggtatggtatgctcacacacacacacacacacacacacacacacacacacacagagagagagagagagagagagagagagagagaataaattctgtgtgtattcttcattggagtctgtctgtactatttttcactgtttataatacttttgacactaccagactctcttccacaatgacccctgaaccttgggaggaagagtatgatataggcattttattcagtgactagaattgagcaatcttttattctctgcattttgaacagctgttgatctctatgctaagcacaatgtgctaaaaaaaagaactgtctctcaagagggttgaaaaatacacttagctatgagtataaagataagtcattaggaggtagattaatactatgttcatttagcagggtaataacatttgactttcccttagggatatggtctgtttggctaccagttttggggccatataacagggcaatttataagtttcaaattggggagcaggccttaaatctagccagaatgtaagttggttattctcataacattcatacacctattgcatcagtaggcaatttttccaggcctgttagtgttgccacttgcttgattcacagctatgtaaatggcacttgaaattgtttttaaagaagacacaaaattaaatgggtagggaaagactgcatctgggagaaatgagacgaaacagtgaatatgatcaagccacactatgaaattcacaaagaacaaataaagtgagggaatagatgcatgaaagtttgctgatgccatatcatatttttattatatcaataaggacaatgtttctttttttaaaggtttatttatttattatgtaagtacactgcagctgccctcagacacaccagaagagggcatccgatctcattgcagatgtttgtgagccaccatgtggttgctgggatttgaactcaggacctccaagaagagcagtcagtgctcttaacaactgagccatctctccagcccaggacaatgtttctaagagagataaataagtagggagagagagagaaagagagagagagagagagagagagagagagagagagagagagagagatctttgttgaaatggattatatagacattattcagtcaattactaaagattaatatctcaaagagtcactccacacttgttctttattctttatccatttttcctgtaccacattcagtggcagttgtatgcatgtgactatttgttgttgttgttgttgtttttgatacaggggttctctgtgtagccctagctgtcctggaactcactttgtaaaccagattggcctcgaactcagaaatccacctgcctctgcctcccaagtgctggtattaaaggcgtgcaccaccacgcccatcgcatgtgactttttagttagcatcctttcaggaatagaattatatccatgtttatactgatcatatcactaattaggatttgctccaagccaatgcattggtacctaacctatagttacaaaccaagacttctgacctgaggaccatatttttcaaagaagaaaaactaacatagactgagcagttaattttttcactacatgtctaataatgagaaagcccagaaattatcctcagaatcacattttctaatgaaaaaatgttggaggcttctaagttgtcacacgtaattcattttccacatgttagttacaagttgatctctagcatctagtatgtgagctttgattaccaaaaacatttctatgcatttttgtgtaagtaacacagtgtggcttcctctctccttaatttagacagaaattaagagttaagtatccaccctgtcaggcagtagtggcacaagcttttaatcccagcacatgagagtcagaccgacctctgagctcaaggacagcaatgtttacagagaaacgtccatgacagctaaggttacaaaggaaatcctgtttcaaaaagcacagaacaaaacaaaatattgagcatccagccaggtgcagtggtaaatgtctttaatctcagcactggggagaatactaaaaataagtgtgattggcatctctctctttcaagaaaaatgtgttctgaaaagtagaaagtcctattaccatacttgacagtctgttatatacatactaagatggagaatatggtgcagaggttcagtatagctataaggataaaacatcaatccttatcctaaaaaggaggctgagtttgctgcatgacttttttttttttatatcaagatgattgtgacagcactcaattttactagcagtactaaaaaggaaagatgtaaataccaagaggttgggccgtggttgcacacacctttaatcccagcacttgggagatagaggcaggaagatttctgaggccagtctggtctacagagtgagttccaggacagccagggctacacagagaaactctgtctcgaaaaacaaaacaaaacaaaataccaagagaaaaagtgtcatcttatgcacattttcttaattattgtgtaaacttacccatcttcattgactggatatatttattgtcggtacaattgttttatacagtcaggtactatacaccgatgtataggattgttatggattactgggctgtgtatctggagaagatttggtttctgcatgctctagtcattaaatggtgctacttaaatataagatgggtaaaaataaaaggaaatattggccaatttgtaaagtcaaagctgatacctgcaaacccagcctcagtaaggtctatggctttttcagtaatttaactgcatatcattttcattaccttcatatcaaaaccataaaaataattaacactcatttttccgctttaacttgctaacaaatctaagaaacatatctgaatttgttcctaaaagcacatcatctatgtcatcttcctatgtagatctgcatgattttgccacttatatcatttctaacctccaggcttatactggaaagcatacctgtgcagaaatccatttgaattagttcccccatacccaaccctactatgactctgattttctatacagttgccagttttgaatctctatgttagttatcatatacataagaaaagaagcatctctaaggatgtttgaaaggtacactaatctgtcttacaataagacatggcagtttgttttaatactgcatgggctagacatatttaattttgacagaagatagagtcaccagaggaaagggatcctcaactaagaaagtgagcccataagcttgtgctataggaaagcctataaagcatgttttaagtagtgactgattggtgagaactcagcccagttgtgtgttgtgtatctctgggcaggggttctgggttctacaataattcaggctgagcaagaatgaggagcatgccagtaaccagcagtcttccatggccatcacatcacttgctacctccagttctctgccctatttgagtttctaacctcactttattttgtattgtttttttattagacagtttcttcatttacatttcaaatgctattcccaaagtcccctatacagtccccctgccctgatccccaacccacccactcccacttcatagccatggcattcccctatactggggcatatgatcttcgcaagaccaagggcctcactcccattgattgctgactaggccatcctctgctatatatgcaactaaagacacagctctaggggatactggttagttcatattgttgttcctcctacagggtttcagacctctttagctccttcagtactttctcaagctccttcattaggggccccgtgttccatccaatagatgactgtgagcatctacttatgtatttgcgaggcattggcatagactcacaagagacagctatatcagggccctgtcagcaaaatctttctggcatatgcaatggtgtctgggtttggtggttgtatatgggatggatgcctgggtggggcagtttctggatggtccttccttccatctcagctccgaattttgtctctgtaacttcttccatgggtattttgttccccattctaagaaggaacaaagtatccacactgtggtcttccttattcttgagtttcatgtgttttgcaaattgtatcatgggtattctaagtttctggactaatatccacttaccagcaagtgtatatcatgtatgttcttttgtgattgggttacctcactcaggatgatatcctccagatccatacatttgcctaagaatttcataaactcattctttttaatagctgagtagtactccattgtgtaaatgaaccacattttttgtatccattcctctgttgagggacatctgagttctttccagcttccggctattataaataaggatgctatgaacatagtggagcatgtgtccttacctgaccttctttgattatgttcagtgatatgaaagtgtaagccaaataagcactttctcccccaaactgcttttgatcatggtgcttcataacagcaaactccctcaaactaaaccaaggactatgtctctttatcagattatcatagtgggttgttggtcctgataattgtattatatatatgtttcatcttgtgaaggggatcttaagttagaacgtagcttgttactcccatcaagtcctgtccactatttcaacacagagcaatgaaaaagacttttccaggtctatgaaacttcactactccacaatgccaaacaaaaatggtaaaaccattcctggcacatgactttttaattttcagtcctataatatataataggagcatagttctcccataatatggtaacatcattaaactattaatatctgtgaatgtgtatattttaggagactctgaaagattagtctctcgtgactttttcggaagttctttagtattattttttcctcccaatattgctttctttaacctacttccccttcctctaccacaatagcatcctttctgatccaagattcctctttcattctggttattatcgtgttatttcttccctagattgaagatttcttatagtgcagacttttgagaacttaccatgatcaagcttttctctgactgtgttggatgtagctccacaatgcgttcttaagaaaaccatatttgtatatacatataatttgaatattttatcacttatttggttacagaaatcatgtgtggcaacatatttaggtgccttgtctgtaaattattaggttttatgtttgtttgtttgttttttactttgaagtatttttcagtatcttggatggtcatttttattctccttttaattctgctgaattaattttaaacactggctgtttataaacaaatatacacattagatatataattttgatcgtatgaattcatttttacattttttgtgattacagaggcaagagatgaagaaatttgtgtaccatctgtgataccatgcctataattgatcttaaatgatcacgtgggctttccataattcactatcaaataacaatcagttttagtttttcaactgaatgtgcattatttttaagtattctgtgaaaaatgtaaatcctggtagaggtgaaaatcagaatatgtgattatgcattgtaagaaggttcatgttggcataacacactgactctgtgtgaggaatatatcgcctcaggaaatattacatgtatctctcctcagagctcctttgaagaactaactactgagatgcaaaggcttcctttcaagaacatccaaagacagtcgcaatggcagagaggtagcgatcacagaaatcaggctgttcatatggagagattaagcttaacaaatccagtcattacttatggcaaggaccaggttaggagattcagtgaatgaacaattattaaccaatataaaatttaggctagaaattttaagtgtgatctcaaatcgcttgtgaaatgctggagaatgaaaaagctaatcttataccaattattcgggagttttgccagatcaagttgccaggatccttacagaaactatgctttataagtaaatttggagaggagatgggtgatatttcatcttgttaaagcagttgcctagcatgaacagatttggggttgaccatcaccacaaatacaggcaggactctacacacaagtgattacaacacttaggaggtaggtgcagaagaatatgaagtttatcatttttctggacaagatgagtccatttcaaagaaaaattaatatatgtctgtaccattgtatgatggaaatatgtaccttaattttttattttacaggggttacattaaagtactgacttgagttttagaagagagtttggactttttaacagtattgattcttttaaacgttatgaagaattttgtttgtttttcaaaacagactctctttatgtagttctgtttgtcctggaacatgtgctgcagaccaggctggcctcaaacacagcgatctgcatgcttctgtctcttaagtactgtgattaaatttgtgcaccataaccacctggcttacaaggaattttgaagttgaattaaacatattttgcattatggtgtggttttgatactatgagagccaaggagtgaaacctggtggtttgaatgtgataccccctattattcataaatattcaaatatttgaccctgattggatgtttatttggggaagataaaggattgtggcattgctaaacaaagtatatcccagaggatattctctgagcttctacaaaactcatgttatttcaagtttgctctctctgcttcctgtctatgacttgaaatgaaagttataagcagcagcatagcttcttgctacctcttctcctccacagatgctatctggaatcacaagcctctaataaatgcttttctataagttgctttggttttatcacagcaatagaaaatgtgactaataaataatagaaagagagattttaagaggaagaaaggaaaggagaggagattggagggtaagtgaagtgagagaagagaagaggagagaaggagaaggggaggggtgaggaggggaggggcaaggagaagagagaggtgactggccggttttatgactggtcttgagaaaagttaggtctgtatttttaccatgtagaaccaggtagttagatttggaagtaacttaacctttgagcaatctctccggtccccaaatacaaagctttatgtaatatttcctttccaccaccgtatatatgtcttactttcaagtaacacaaggaactacctttcatgagttttaggtttataaactgctcttttaaactgatagctattctgcttggtagttcttaaccaaaaaaatatgttaataattaaagggaaaattatgaatgtattctatgacaagaattttctccactggttttgcttccagatcacagaaattaaaaaaaaaaaagattctcttatgtgaaaagatacaacacgtattttagcattataccagctgatttgatgtaaacttaacagattaaaatcacctgtgaggaagaaataaaaaattgggcaaattccttataagatctggctgggggcaaggctgtagagcattttcttaattagtgattgatgtgagaaggttcagccattctgggatattgatttccctgggatggtggtcctggattttgtatgaaagcaggctgagaaagccatgaggacttatcatgtaaggggggctgtgatacactctattcatcagcttctgtctccagattcctgccctgctggagttcctgctatgacttcctttgatgaagccctaatgtggagtcgtaagcaaaaccaaccctttttctccctgatttgcttttgatcatgtttaccacaaaaatagactgactaagacatccagttttcttcattagcctctgttttcaggaccactatttaatttaccacctctgctaacctgttttgtggagcttttgattttttttccttttaatcagatacattttcagtgctcaactacttgtacttcatttataattgaatactgggactggtgtgttggattagtagttatcctaatttttgccaattttgaagaattgaaatcaattcccagaatagaccaatagtttagtgccacaagttctgctcagcccccgacacatgcatgttatcacatgtaaacaccatgcacacactgaaccaatgcatcagtgggaatttacagtctcactccaacttcactttgagaatccctagaaggagaaactagtaccttagttcatttctgcatgatcctgcatacagagtacaaccagctatgaagacagctaactgattaagagtaacttaggaagatctaaggattgctaactcaaaagacatataggagtagtgatcccctttgcaactttattttttacttctttgtgtcttccaggcctacttcagcatgatttctgatatggaaatgtctattcaacaatatatttctgctgtacatacctgtcaagtgttgtggtttcaatatcattcagttcaaaatgaactgttcaagtcacatagaaacttgtcccaaagttaagcattaaatctatacattttactttattttattcatgtttgtgttcatgtgatcatgtctagagtgctcagagcatccaaaaggaagtgttaggtccccagaaaagaaggttcatgaacctcttggtatgaaatgtatatgctggggtctgcattcgaattgtttgatgaagcagttcttaacttctaatctttctctctccctctttttccccttgtttctccttctccctgcctctttctccctagccctacccatgtctcctagtttttgagacagattctttcactgaactcagaacttgctgaattggctagactagccagtcaattccaagatcctgctgcctctcttttttgtttctggaattacaggtacatgttgtctacaactatttctcatgggttctaaggactcaaacgcaagctctgcatgcttgtcaggaaagaattttattgagtagtctatctccccagatcctgtattctttattaatagaaatagtcattaatgcttttaaaacaagtgatataaaacaaccaaattcataaaatccaatattcatttaggaaattgatcaatatttattcctttagaagcactgtttgaatttcactattcttttttattttggaatttcactaatcttattgttgctgcatatgtatatgtagagcttgtgagtagacggatggtgtataagctttggcaaacatgtagaggccggtgagtaactttgtaaaaatatattcttttttttttttcattttgatgtatgctttggtgattagattcactagaaacaccctttgaatttattattattattattatatatgtgcatttgtcgtttgtgtatgtatcgatgtttgtatgcctctatacacatgtggaggccagagagtacctttgtgagattcattcttccattccacattcatacgtgttttgagaagtgaattcagtgtgctaagtctatggagccggtattgcctgctaaggcatcttgttggcctctgtcttataaactctcctttttttttttggtttttttcgagacagggtttctctgtgtagccctggctgtcctggcactcactttgtagaccaggctggcctcaaactcagaaatccacctgcctctgcctcccaagtgctgggattaaaggcgtgtgccaccacgcccagctataaactctcctttttaaaatttgtttttctcttatagtttagagattatatcatttctctcttacctttctccctccaaaacctcccatatgaccgtgtttgttttctttctcattcatttcatctttctttcattaattattgttcaaatactgtgtgctatatttgtctactttatctagaaaaaaagaaaaagaaaaaaacagaaccaacaaatttgaatgtgatcagagtctttctgtagagatcagagttatatccatatcttattccatattttataaaatcatgttgtttaaactgtccctttccctaaataagtacattttataaaacagtacaatattctatttgatataaatgctgaagcagaatgtagctgtatcatggttttccatataaacacacacagtctttgcagcctgaaccactaggcaaatataagtaacttattcatatatacaaaaaatgactaccatcagatttctcaaggtaaatcaaaagcacatgggaggcatactacaaagatctgaaaactcagatatgtgagcaccagacccccatgcatctgtgcctacaccaggagtaagccaggactgtgatatggaaagcacactcaccagtcataatgtcactcatcacaaaccatctccatggaatttgccacaactgaggatttataccttattattagttagctttctgttgttttgataaaacactgacaataaaagactttgggaggaaagggtttattgggtctgtactttctctttctttgagacactcaagtcaggaacttgaaagcaggacatagtgcagagaaactctgcttattgacttgctcatcctagctgctcaacctgtttctaatagaacccaggtagaaatgcctagggatggcaaaaacagtggcctgagtcctcctgcatcaatcattaatcaagaaaatactaccacaaacttgccaatttgatgagccattttctcaattgaggttccttctgcacagctgaccatagtttgagttaaattgaacaacaagccagaccacttctgtaccctgaattccaaacttctcagtttctaatgactgtgacacaaggtccagtatcccccggaactcgtgtctctagctgcatatgtatcagaagatggcctagacggccatcagtggcaagagaggcccattggtagagcaaactttatatgcttcagttcaggggaacaccagggccaagaattgggagtgggtgggtaggggagtagggggggatggtatgggggacttttgggatagcactggaaatgtaaatgaggaaaatacctaattaaaattaaattaaaaaaaaaaactttctgactggaagctctggtggtactgtttggttcatattgttgttccttctatggggctgcaagctccttcatctgcttccattctttccctagctcctccattgggaaccttgtgctcagtccaatagttggctgagagcatccacctctgtgtttgtcaggtactggcagaccctctcaggagagagctatatcaggctcctgtcagcaagctcttgttggcatccaaaatagtgtctgggttttatgactgtatatgggaaggatccccaggtggggcagtctctggatggtcattcctttagtctctgctccacactttgtatctcctcccatgggtattttgttccctgttctaaggactgaagtaagtatccaaggagctaaagggatcttcaaccctataggtggaaaaacattatgaactaaccagtacccctgagctcttgactctagctgcatatgtatcaaaagatggcctagtcggccatcactggaaagagaggcccattggacacgcagactttgtgtgccccggtacaggggaacgccagggccaaagggggggagtgggtgggtaggggagtgggggtgggtgggtaagggggacttttggtatagcattggaaatgtaaatgagctaaatacctaataaaaaatggaaaaaaaaaatttatattattggttagagtttttgttgctataataaacactgtgaccaaaggcaacttgtgaaaaaaaaaaaaaaaaaaaaaaaaaaagagtacacatggagggacctatagctccagctgcatatgtagcagaggattaccttattggatatcagtgggaggagaggcccttggtcctgagaaggcttgatgccacagtgtaggggaattccatgacagggaagtggaagtgggtgggttggtgagcagggggaaggggagaagatatggggttttcagagaggataaaatttgaaatgtaaataaagaaaatatctaataaaaaaattgagtgcccaaatttgcatttggtacctttccaccttggagaaactttatgtctgccttgatatttatacagcttcttacatgggccccatgtggggcttttgcttacaccaactatagccttcagtgaagcccctttgaaaccagtagtctctttaacacttttatattcaatttgtaatctagtcctctctctctacctctctcttcttctccctttcccttcctcctctcccctcttctctcttacacacacatacacacacacacacacacacacacacacacacacacacacacacacacacacacatacacatactctactttgtgcagtaatctaagaattaccatttataatcatgattcactcattagctctgaaggcctcagagcttctcatgcttaaggtctagtggcttcttccttcaaatcactgggtttagagcaaatactggcaccctatgttctcacaaaatgtgtgcgtataagcccgagaatcatactagcaatctcacacttttgaaacaaatgaatgatacatctaaattccttgtatctagagaatcagatcataaatggttctcagttgtcctgccctgtgttgccctggcttctctgtgccacctcccaccacccttttccttcgtgtaaagccagtagaaaatattttcattggtggattattatcctctaacctgaaaatgtcaatattagtggtggtaaatggggagaaaacagagtgattacaaagcagattataacaagagatgcaatttggcctgcttttggaaatagtacagtgaggtgagggttggtgtaatcctagtggaagagtctctagtccatggcaggattagcagttcagaggccagatcagaggagcaaagccactgacatatgtttagttgactgttttgagccagtactgtatggtgttctaaacctatgtaataggtgccatgtaagttcttcgttctagtatggtggtagagcctcatgtatatttgaaacctgtgaagaaagatctgtgcagttcctactgtagtgtatagaagaggatgagctgaatctttcagtccatgtcaagtatgttttttctctgaacttagtagtagggtgtgtatttcgtgagtgtactttatttgttatattttataatgcaccttgccatataaattagcagttgcaaaactcatgctttgttttttttttgtttgtttgtttttgttgttgctgttgttttgttttgtttttgagacagggtttctctgtatagccctggttgtcctagaactcactttgtagaccaggctggcctcgaactcagaaatccacctgcctctacctcccaagtgctgggattaaaggtgtgtgcctccactgcccggctgctgtgtttttcttgtttagctaactcccatatagttattgaacttggggactaatatacaaattctagaaatcagactaagccatgatacagaaagctttttttatttgttttggtttttcgagacagggtttctctgtatagccctggctgtcctggaactcactttgtagaccaagctggcctcaaactcagaaatccacctgcctctgcctcccaaatgctaggattaaaggcatgtgccaccactgcccaggaaagctttaatcctgttgctaggaaggagaagcagagggaagtctgtgaggccagcctattctgttgaataagctctaagcctggcacagctactatgggaaatccagccttaaaaaaaaaagacttatgtatatgaagaacttgctgtcaatcatcacctgaaaacagttgtaccaaagaaagtctgactgcattgcattatcacttctctattgaattccattgccctttactaactaccatacttatggattttcaaaaatagaacatacatctcagaaaattcaaagccaccacccacaaacaagagaaaatatggtggttcgcgcctttaatcccagcacttgggaagcagaggcaagcagatttctgatttccaggccagcctgttttacaaagtgagttccaggacagccagggctacaaagaaaccctatctcaaaaaaccaaaaaaaaaccaaaacaaaacaaacaaacaaacaaacaaaaacaaaaagaggaaaacatgcaaagtttttatctctggttctctgttactcccttcagaataattattttcagctccattcatttacgagtttcatattttcagtttttcatgagtttaataacagtacattatatacatttatactaaatgtttattatctattacttgaatgatagatatctgagctgtttccatttcccatgcactgtaaatataaaatcaatgaacatggatgagcagggatatcagaagttttatataggttcttcttggtatatgaccaagaatgttatagctagagcatgtagtaaacatatttttagcttattttataagataagaactgattttcataatagatacaccagtttgcactcctaccagagttcctttttctgtgtacctatgagagcattggtttagtttctatatttatcttagccattctcattggtataagatgaaatctcttaaaaatttttaattttcatccctgagaagtaagtgttgaatgcattttaaaaatgtttctcagccatttgtatttcatctaatcagaattttgtatttagtttaatggtccatctttgaattttttaatttttctttattttatttcatttcttatttttttcttttgttttgtttttagacaggttttctctgtgcagtcctggaactcactatgtagaccaggctggcttcaaactcagaaatccatatgcctctgcctcccaagtgcttggactacaggcatgtgccaccactgcccattttgaaatttctataatttttgagattataatttatatatctccattttctctcactttctttctttcttttttttttttttttttttttttttttttggtttttcgagacagggtttctctttatagccctggctgtcctggaactcactttgtagaccaggctggcctcgaactcagaaatccgcctgcctctgcctcccaagtgctgggattaaaggcgtgcgccaccacgcccggcttctctcactttcttaaccctccaattttcctatgtctaggaactctttgaaatccatggcctctttcaccataactattattgaatgaatatatgtatatacttacatactcaagaccctcttgaagtaggttggtttttctttgtttttgtttgtttgttttgttttttgtttttgtttttggagacagggtttctctgtgtagccttgactgtcctggaactcaccttgtagaccaggctggcctcgaactcagagatccgcctatctctgcctcccaagtgctgggattaaaggtgtgcaccaccacgcccggcaaggttgtttttctttttcttttttttttttttttaattaaaaatttccacagcttaaggaactaaggggacctcgcagtaacagcaagggtgaaaagccagaggccagctaagggactaagcctgtctatcaaaataaaacccaatctttattaatatagaaatatctacttttctagccctctaggaaaacctaaatttcaaatcagaccgaaggccacgtgctggaatgtcctgagaatggaaataacagctgccacctgtgtgctctgggggggggggtgcacatccactggtccggctggagaatgctgattaacgagaagagtcagaatctgtgttctttggacgaattagtctctctggcagccaccgcgctccatcttcatctcgtgaaaaaacacaaaccgagcccctaccccaaattagaactggatctggacccttccattcattagtcagggggtcctagcattttaaagcaccatctacagcacacaactagattatttgttagggttgtttttcttaatgttacattttagaattgatttgtatatcgaaaaactctctattaaatgtatacatgatagagattttttcccaatccaaaggctgttccttcaatttaatgatggtgtccttgctatacataaactttttagttttcttaggtcacatttattacttgtagaactttcctgttaagatcctttcctgtgtcagtgagttcaagtatcccatactttctactctatcagaatcaggatatcaggtcttaagttgcagttctcgttttatttacagttgagtttgtgcagggtcagagttaaggatatagtctcatacatctatatgtttctgtgcagtttgaccaccataatttttttttttgttttttgttgtttttacattttgtgaacaataacatggttgtattagtgtgggtttatatgtgaatcctcagttctattccattaaccagtgtgtttatgtcagtatcatactaattttttttcttaccttagctctatagtataacttgaaatatgggatggtggatacttcctgctagtttattattcaggatgtttttggtacagtaagtcctttgtgtttccacctgaaattctaattttaaggattgaggattacataatcaaaatatagatcaacactgaaaagcattgaaaatgtcagaatcctatagtttcaaatattaagctaggttttaatttaattttatatgtaaaaataaacaagcacctctatctcattagcataaagaaagcagactaaatatttcccatatacaatgtcacagggtatgcattactatttcaaaacggaggaaagggagcattatgaagaaatgctgaatgaaaacaaggctgaaaaacagttaggcaaactccaaactctgcatcttcatactgatgtcaaagtgcttttgcaatcttcaactcatttagctttgttgacagttacgtgctcttctctgttgggctgctttcacagcctgtgagcagctttcctttgcaggtatctcttggttctgtatctttaaaattttgttgtctctatggtaattaaggcttcacagcttcaaaaaacagccatgttaggcctacatgcaatacactccagacacatacctgaccataatggctttgcataggtgcaaagagtgttttcctaagatctttcttttaaccttgattctaaagccagaaccacatagcttgttgtgggatattcacaagggaggactactcagagatggatttgacccaataaaaagtctttactcgccaaccactgactatactgggtcttggggatcccagtgttaccctggacctttcttggaatgaacttttaagcaggaaaaaaaaaacaacaacaaaaaaacactttctgggtcgacatatctcagttaatgaaaacaactagccagaagcagaactacaaaagctaaagtgcacagttggtgcattttgagactttgccaggactatatggatttaatgaataatggctttgttttcattttggcaggtgctgtctacatgctgagttttacacactgaatgttactttcatcaatggagtcagttgtgctatgttttagaggcctaataaggtctggatccttgttatatttcccacttgtcttagtgaacaagtcaaattatagactcattttgctatagtgtaaaatttcagagcttcattgttaatataatctttcttttatctcttgagaagtctaagtctgttcaatttgtagaattatctctgccagaggatttaactattgttttgattcatcaactgaaacttttaatagatgttgattaatgtatctatttagtttggaaagcattagtcaaaccattagtacatataaacagggtagttattatcagaggcccagtaatactgtggttgtcaaaataaattaacccaaaagcagaatagcagtcatcaaaagaagggaaattcctagactaaatgttttatatatagtacaaggtttttgtttgttttaattcctctaacattactttgggctgtctccagtcacactgactttcattggtcaatagatttgacaatctggttagttcccatacttaagtactacatgggtaggctgtctcagcataaccagcacaccttgcttatttttggctaggaataattatgtccattcccaggagtcctttctgtatcatagagtctgattcccatttgtttccagggacaatgggtattgttctatctgaatggaagtagaagaaccagttagttgaacaattataagatcttggtgttggtccagtcctgaggtattggtttatgctgacagagagagtgagacaccaaaattttcctagttatctgtaagtctgagtctcatcagaaaaagtgacaatatatctcagtctatctcaaaggtcttgtcccaatcagctctctgctgttgaatactctgagctacttccaacaattggggcctggtaatatttttatttctcttaacttttataacatttttataatatctatggccaactgggtgacaaaggaaatctgttttgcagctgtctttctcaaaagtaccactgagaattagataaagtctccttagggttttacagaaggggaagtcccttttgttcaggctgtgttgtctggcagtgattctgcggcccagcccacaggcagtttagttcctattctttagtgctgtgtttttatggatcattgattgaaacagtgacagcagtcataaaagagaaaaggggtcgaactttgtattttccttcaaactccgccctgaggaattttccccttccctagggctgcttagagaaggaatgactggtacagagggaattctcacctgaggaaattattttcctcatcctgtatgcattgtgccttgaggacaaggggccctgaatgagtcacttggcttctcccctcctccacactgaaaccaaccctgtgagcaggattcaagcaactaaaagagcaagtgctcctgctccagaagtgggacaaatggaggattttttaaggtttttctgggtgacatgggagggggaggggcaaaaggattcaggtccccaacaggatgggactcaggtcttaagtgagaggtttcttacaccaaagagagccactggtcaatagagggagaaaggactgacaaaaacacatacagacacaaaaaagacaaccaggaagtggctaacacactttcatacacctgagcagacagaaggatctagtgaagttcatatggatcctgcacattgaatcagcatccttgtctgacctcacctgtgtgtccaaccatgccttaaccagacttacctctggaggtaaaagaccagatgactgtctaatttagaaaccttagaggtatcagacacctgtaaggaattagacagcatttgatcaaacagagccctccggacctgtaacatctcaggctctgtacctcctagaagtcccttggccatcgcatccctccaagtgattctgagacacacggtgttttgaggtttggtcgctgagattttggtggaacgcccagaaatgttgtagggctttcaccagagaaaactgcttagacatgagcttaaactgatagaaagtttttattaaccaaccagcaactacttggggaattcaagatcccaatgtagccctgagccttccttaagataagcttttaagcatgaaacccatgtgcagtgccgggtggtgatggtacacacctttaatcccagcacttgggaggcagaggcaggcggatttctgagttcaacgccagcctggtctacaaagtgagttccaggacagccagagctatacagagaaacctgtctcaaagcaaagcaaaacaaaacaaaacaaacaacattgctttagtattggcaggtgctttctacttgctgagttttgcagcatgaatgagcatgaatgatatgatacggtgtcagttgtgctaatgtctggaggcctactaaggtctggagccctgttatatggccaaagagctcaagcacagctgctttttgggcaggaatgtggccccttgctttaattacatctttatcagctttctatttttgatagtttcctttattgcctatgtttggctgttctctatcttactttccaggccatgctgacattgaacctagagatttaccaatctctgccttctgagttctgggattaaaactgtgtaccaccatacctgtacctaaaatgtttttaaattccttttcacaaattacaagtttagctaggcaatgtcttgacctgaagtcaccacgtctttttttttccattgtgctttgggcttttctttaaactttttcctggtgcccttctctcttcaaactagatattttatatttattcttgctcagtttatcccttttcactacaaatctataaatactggccaccagtaactaaataacacaaacaaaatactaggttgttctgaaatgtcctctaccaaagaacattccatttggcatgttccaagctgtttatcaattatacttcaacttagcctgaggaagagttttgcggggcaagggcagaaagcagccacctaaccagaatatcacaagaacagcctctaggatgtgtattaatattcttctctgaaacttcttgatccaggccttcaatgttcaagtcacacttagtatcactgcctgccctgcttctactattctgacctattaggctatacttaaagaattccactgcttttcttatgcaaattaccaaagttcacattcctcaaaataaaataacatggtctggcttatcacagaattacttcagtctgtgatactaacctctgtctcagatagggtttctactactgtgaagaaacaccatgaccacagcaactctaataaaagaagacatttagttgggactggataacagtgatatttctagtccattatcactgtagtggaaagcatggcagcatgcaggtagacatggtgctgaagaggtagctgagagttccacatctagataggtagacagctggtagagagagtgacactgggcctgacttgagcatctgaaacctcaaagcctatacccagtaaaacacatctcccaacaaggctacacctactccaccaaagccacacttcctatgcaactcgatgagcctatatatggggaccattttttattcaaacctatgtgtgtgtgtgtgtgtgtgtatgtgtatatatatgtgtgtgtatgtgtatggatatatatatatatatatatatatcttcaaaaatatgattatgttatttgtgtgtgtgtgtgtatgcttgtgtacttgcatgcctacactatccatgtgaagtcagaggacaattttcagagtttgttctctccttctataggttctttgttttgttttgtttttgtttgtttgtttgttttttgagactgggtttctctgtatagccctggctatcctggaactcactctgtagaccaggctggccttaaactcagaaatccacctgcctctgtttcccaagtgctgggaataaaggtgtgtgccaccaccacccggcccttctataggttcttgagactgcatattaacatattgagccgtctttctggggagagagaaagagaagaaggagatgagagagagagaccaagagagatcttattttatatgcaaattatctatatttgttcaacacattatgatagtatctttgcccaacagttttcttagcagatttgttagcattataccttcttaaatagtcattttctttttgtgttgataaactttaattttctattcagtagtggtggctggtataggaagctgaatgttcacacctttaaataaagcagcaaccaaagagagcaaactggaaactgcacaggtttgtttgtttgtttgtttaaaaaaaaaactcaacaccctctctttgtgttttactttttccaggaaggctacaccgcttaaacttcactaaatagaaccatcacctgggaaccaactattcaaataccagaatatgtggggaacatttctcacttaaaccatcacagatactctctagccctgcaagcctgtcaagcaaggtccagagttcttatatactccagagaagtaccataacacttgctgtgccattgataaaacagactgcacacagactgctgacagtcatagggctgggaaaatgacatctgctctagtttatcttggtgccggggagaaaggtacatagcactccaggggagataattgtttacccataagacaaacttaatctcattttaaaaaaggtgtgtggggtagtgggtattttgttttgttgttgttgttatttttttccagggacagggtttctctgtgtagcactggctaacctggaactcactctgtagaccaatatgttctggaactcagagatccataaaagcatccgcctcttagtactgagattaaaggcatgagatgccaatgcctggctcaaaagaagtttgaagatttttctgtttgcttgtttgtttgtttttgacatagagtttctctgtataacagccatggctttcctgaaactcactctgtagatcagactagactcaaacttaaaaagatccatcatacctgacttaaaaaataattaaaaaaaatactttaaagggtcttgttatgaagcacttgctgacctggaacacactacataggccaggctatgctttaagtcacaaagatcacactctgttctcagcacctaggattaacggcaagtactactacaccgagcctcaaagttaaatctttatcatatgcattatttagcattcatattttctgtaaactgctgcctaggctttaaaacctttcagaagttcactagtctagcatttggcttttaggtagcattttcctgaggcattcaaggctcagtacaattctcaccacatttacctatgaatgaatctagaaaagcaaattgtctgctttagccagtctttttttttttttttcctggagcctctcttagatttttcccaagacattgtcccccatatgtcatttttgaccatgttttcatatatctcaaagagaagagaaatgcatactctctcacttctaacttactttctccatcttcactgattttttttttttgctttatgtacaagggaagaaaaaaataggatgtggaaaaacagaaagtctaaagtataaggaaaatggccatagacattattttggagaaaactaatttccctttgcaagtggacatcagttgtaaatagctagttggtgggagccactatgcatttctctgtctaagcactgggcacccatctggcttgaacctgtgtagtcttgtgcatatgttaaccccagctcaggctaggccctatgcccaggagtaggtggaaaacacaaaacataattttggtacttttatggatgattggtcttatattgttttatttgtacattttttgtcttattggtctttgcttggatattttggttatgatcttttttccatttttttatgattttacttgtgttttagagagagagatgaaaggcatgaagtaagggagatagggagaatctgggaagagttgggggaggggaatatatgatcagaatatattgttaggaactaatttctttcaattaagaaaaaaaaaatttccggggtagtggttcagtgtataaaaatagtgactgatttttcagagaacccaggttcactttacagtacccacatggaaggtcacaattgtccagttctagagtgtctgacaccctcgtgtagcctctagggacaggaggcatacccctggtgcacaggcaaaaacttataaagtaataaaataaactgtagtgtgtgtgtgtgtatgtgtgtgtgttagagagagagagagagagagggagagagagagagagacaaagagacacagagagacacacacagagagaaagacaccccctcccccagaaaatgttatctggatagaaacaccttttgatctaacaggaagatcctgcaggtcatcaaactgccccctaggaaggagacaaaagagctccaatcttaggatccttaaagttccaaacaagtgttaaagaaaaataggtcatgaatttgaaagagagtaggaagtacatgggaggtcttggaataaggaaatggaaggctatatggtaattttctattataatctcaaaaagaacaaaacaaaaccaaaaaaaaaaaaaaaaaccaaaagaaatgcctcactgtatttttgggaatctttcaaagctgtaaccacagcgacccctatcatccaataaacctgtggctgaaattgtgtgagagtgttgctatcaaaagtaagctttaaaaaaaaaagttttgaaaaagcagcgtagtccatgaaaaaaaaaaatacagcaagatttttttaaaaaaacatttcttttaaagccaaagtaatgtaaaagtgatgggggtcggggtcacacagcatcccaatttcttctttctttttgtttttgggttacagaatttgaggataaagcatcttctgacaattgtgctacccttcaggaatagaatgatctctcccattgttgaatgattctttctaaaagtgtgggagccatgcaggaatttggcttattgtgagacagctgatgttttctacttcatcttcatataaaatcattctgcctttgtaatattacgagccacgtggtaagaatttacctgtaatcttcctaaatctaacgaactcagttcaaatattatggaattatattgtttgcttgttttccttctttgttttttttttctttttctgagacaaggtttctctgtgtaaaagtcctgactgtcctggaactcatgttgtagaccagactggagtcaaacttacatagataaacctgcctcacttgggcgagtgattgctgggattaaaggtgtaatttaccactgcctgtcttgttttgttttaagatagtctaactctgttgtccagtctaaactggaaaatactgcttacttcatgggaggcaacgcttgattcatggcaatttttctgcctcagattttctgggataaaaggaacaaagcaccatgtttttagctcaagatggttgcattagtttgcattcttatcagcatggagtaagtttttaagtccgttgtctctgtaatactcaagtacattaattttatattcaccagggcctttcagggttagcaaatctgtaatgctaggactaggaagcagagtagtagttttgatgcagcctagtctacatagcaaattctaggacagtgagaaggacacaatgagactgtctaagaaacaaaaaacaacaggaaaggttttattatgaggcccaggcttgcaaagtgccctctctgtctgatttctagcaccacataattcctgcaaggtaaaattccaacccaaccatgacacatcctgtttcaaaatctccccatcttgggaaaacaaaacaaccccctccttcactaccaccccaacgccctctaccctgccaaaaaaaaaaaaaaaaaaaaaaaaaaaaaaaaaaaaaaaaagaacaaaatcaggcatggtgatcccttgctgtaatgagggtagaaggcttattggcttattctgagttttaagccagttagtgcaacaaaggaatttccaagcacacctggggtagattaagaaccagcctcagaaaagcaacaacaaaatacacaccctgcagcgctgagctacactccaccattcctagccctagtctattgtcttttcatttttccataagtagtctgtccttgtgattttcatttgcatttccatggtgactgacaatagtatctaattgtttagttctatgtaaatagatttcttcagctgttttcgaaagttcaggttttggttacatttagaactgaatgtatcttcattgaagttgaatttaggatgtttgcgaactggatgctagctcagtgcggggggaagggaagtagagaacttccaactttgttagaatacctcattaacagttcttgcaggccctcattaagctatgctaaacccatgtaaatttagcttccttagttttctccttgccattttgttttcctaatcttcaaataattgcatattgaagttactaccacaataatacttttactaggcagacaggaaattaataggtcaaaagtaactgaaataaattcttatatatgtatccacaatctacaaaatgtttttgtttttgtttttagatattgttacaaattgaacctggccttgagtatgcaaaaatactgctttcttagaataagtttcctaagagctggaattactggatggcatttctatgaggtcatatatttgttagtaaatagtgtctacttttcaccccccaggcataacaacatttaggaagccctgtctctaaaaccaacaacaacaaaagaagcagatacataagtttcataactgaatgttcttcctattaaaatttaatcacaccatgatctggaggaaatagttttctcccagtcatatgttctaacacagagaaagaaaatacaagtaatactacattaatgtagaatgtagaattaggaatcaggataacttttttttctgtacagaattttaagtatctgacaatttggctgggcttcatgtttgattgtgtgtgtgtgtgtgtgtgtgtgtgtgtgtgtgatacactatgtaacatgatatagcctagaaaccagtcttcctcatattggagatcaaaccttttttcctctcccacataataaaaatctgtgtgatgcttgcaatcacttgggagcaatttttttaaaaaattaaatgtatttagtaataggcaattatatccattattccagattgacagtgatttttttttttttaatacacgctcaaatttccgcagtaggaatgctcaagcattccttttggtagctgccttttggcaggacattccggtcagagggacagagacccctgcattgcggcaaaaatgtgcgcatgtgcagccattgcctgggacgcatgcgtagggagccgcgcgacaaacctgagccattgcggcaagactagcgcagagaggagagggagccggagatgccagacgcttggttctgaggagtgatttgcaacgcaatggagcgaggaaggtcagctgggcttgtggattctagtagtgaaagtgcatcctatttgaccaaaacattctagatttgggcttattaagatttttgacaacccagatacctttatttttgagaattggtgagcaatcctttggagccggcagacggactccttgggtgtgttagtgcggcacctgcgtgtaacgcgttgcctttattatggtggtctgaggttgtgactgggatcctggatgcaggagctgtgttgccgcagcgtgggggctccaggatgcgggacctcttttgtcgcggcctctggactcctggaagtcagagctgtgttgccgcgacttgtaggtccagagattttggaactattaactgtgtggcctgtggcctccagaatgccggagctctgttggttctgggggtgggtgtggatagaagttctgttgccgctgcaggaacctgtagagtccgggattttgtaactgttactgtgcggcctgtgggctccaggatgcaggagctctgttgccgcagcctgtgggctacggggctgggtggacactcttgtccaaggctgtggctctgttgatgcagccagtgggctacagggcgtgggaactctgctgccgcagtgtcgcagtctgttttctccgcggtgtgggggtgggggtggggagggagctctgttgccgcagcagcctatgtgctacagggcatgagaaatgggcggtcgcagcttgtgtggtctgggggatgggagcaccttcaggggtctggggaactggagctgtgtggcggtggcctgagggctgggagcttggttgccatggcttgtgtgttcagggtgggggctactggagtgctgttgccgcggcctgcgggctatgggggtggtagctccattgccacagcctgtgagcctagggtagagggagcggtagctctgtcgcctcttagttcatgtttgggggagctctgctgttgtggcctttaggctgagggtgcgcgcagggtgtgggggatgggggcattctgggagctctgttgctgcttcatgtggcttcaaggatgtcagagctgtgtagtggtggtatggtagggtggaaggtgagcgctagtgggtgattttctctgagatctctataactacttctcaagatcatgtggttgtgtggcaaaaagatacttgcaagtcagagaagtgattgtgtgtccaggttggttgcaggtggccagagtgcttctggtttggggccttggaactctgacccatggatggaggtaattaccgtacaaagtctggtactgaggccgtagggtgtcatttttagccctgcagtccagtggcagtctgcttctgggtgcttccagggtggggtctactgaggtagataaacggaatgtaccaatattggtggaggggggagttgttgagaagagaacctgtgtagaatggccagacctcaccttaaggatttttcttgcagtcgtcccttctaactgggttgtgtattttgttcttgttgtttccttttgtagaattgtttcccatttacaagatagggatgcaagtctcagtgttccattttcttgttgtgtcactgtcaaccacccctcacagtgggggttagtgtatgaagtctatgcaatacttgcttttacccactcattgagtagaggtaataagacaatgtcttttattttttcatggcatcctgaattttatcaaagtcatcttggtattatcaaggggtcgtgtcgcatgtcaaacgccattgtgaggatctgtaaagatggccgctgctgcagaggtgctgaagtgcgcaggcgcagcatggcgtatacagggcagtagacccctccccattatgctacaaacctaaggagataacagcacttgtcatttctgcggtgttggaatttcagccacaccctttcttaaggccctggagaactgagcctattgatcactggttctctccctacaggcacctgatgcagtagaggtgacacccacctctccctgcattgacaaaagaagggacttctgcagaggaattgtgcagtattggcatcaaggggatgactaccatttccttaacctggtgctacgatagctgagtatctttacccctcctttcctgcagtgtcacagtagggaacggggagaaaaaggagacttgtttgtgcaggtttcttcctcttatcttccaagacctttgataatggaaggtggggggaagcggggagttgaatttttccatgaattctggtatttggaagatggggtagggggagaaggaatctagaggttatcggtgtgtatggcctgtccctgtattcttagttttttagtagtataataggtgtgagaatttagaataatttagccaggtcaggtcaggacctattattggtgatggtgaagatagcattacctaccaggtaggaaatttatatttatattttaatgccgacttaaaaaaaattaaacactctgtagcagctaaaaatataagctgtacttaaagagaagacagaaatttaaaaaccacgattgtacatgatttaagactggatagatttattgataaatgactcttttttttcaatttttgaaatagaaactactctaaatttgaaagaaaaataagcaaaataactgcatttacatttctttatcaaatacacttaaatttaaaacaggtttctgacataaatcaacttagtgtcagacatgatatgtatcccactgtcaatggagctggtgatccaccccaccttctcccttcagtgcttgaaaccacaggtgtgactcctgtgtttcatactttcaatattttttcatgatttttttatgtgcttgctttttttaaaaaaatcttgttttcttcacatttatgggtaggtagtatttatggttgtcatatgtggtaatcttaaacaatgctaaattttagaacatagactttgttttagaagtttgtctttctgacatgacagtatgatcttgtagccaaggttaaccttaaacttgtaatcttcacactgcaattgccagacttcaaaaacatatctttaaaatattgtatataatataatttagcctttagactctagtaacatggggtttcaactaatcttttggctcagctactgttaatgactattataaaactgcttattatggcccactatattttcttagttgaatcagatctctttgatgaggctttctccttttaaaggcctctgaactttctatatctttgccttaagtaatgatttggtgttgtgattacttttgttacccttttaaggaagggtctaactgtaactcaaaatgcagtctcaagagacagttgactattgtgattattgctgcaccagatactgagttggaaaattctgggtgtcttttcttcaatttagatgaacaaatcttaattaagggaactttattgttattaaaagtgttattttacttgttttgttcacagaactttatgttaaaatgactgaatttagtcacttttttcattctactaagtatttccatctagatctattttatttattcctccctcttttcatgaatgtatcttcactttaaaaactcacacttaaaatgtagcttttgaagttaatttgctatatttattactatacttatgttacttgtctaaataatggtaagagaatttataagtaattttttgttttaaggcaatattttgataatatagctgtggagcccaagctagtcttgaaataaatcatcccatttcagtttaccaagtcctatgattttacagggcagatttgctgaaagacatttataagtgtgtacgtgcacacacacacacacacacacacacacacaccacataaggacagttaggttattttttaagaacaggttaagattctataaacaaaacaactgttaactggtcaggtgcttaatcaatctagttttatagataggtagaatttagtgaattggcatttggattctgctttcgacattctttcatgacttgtcaaagaccttacatttgtctttttttcatgtgtttttctaatttcagtattatgaatggtttctgcagttcctaacatggccaccctgaggcttctacttattttcaatttgacagaacggccattttgtgaggtgttcccagatcttaacatggaagtgcattttcccagcctgtttatagcatttccttaagtgaccctgttatttctttgtaaatcctgaagacagctacatgtacatatgaatattttaattaataattttccaatttaattttttatgctttgttagtctggtttataaatggattataatctaaaaatattttctcaagtagtttggagtgatcttggttttttgtttgtacagaggactggcacatattgtatatgtatatatggattatgtgtgtgttatatctatatacatattttttgagatttataattggaaataatatattttacttcattttccaatcttaatccagatttttctcatgtaatgttctcccctaaattatgtttaaatctcaggtcctaatatcttttaaatgtttattttacatacgtatgctttatctacatgtatgcctggatgtcagaggaaagcatcagattgcaatattgataggtacctgtgagccaccacatgattcctgggaattgaactcaggacctctggaagaacagacagtgctcgtaattgctgagccatctcaccatctccagattctaatatatttttaattataaaatactctaatgttttaattgtatcttattttttttatcacaacacgggcttcctatgttagacctggctggcttagaacttatatatgtagaacagactgctttagaacttagagaaatctgtcctttttgcctttaagtattggaaataaaggctcactttgtcataattttatctttttttgaattagattatgaataccttttaacattcactatgcaaatgacaaagattctaagtggagcctttattttttccttcaaactttcattttgtttttagtgtgtgtgtttttttttttttttttttttttgtggtaaagggagggagcatgcttgtatggcagatacagaagtaaacatagttttgtggagcaggttctctctagatgttcaagggtccagggatcaggttgtctagtttgtcttcacagctggaaatgctttacttactgaaccattttatcaatctcatatttctgtttcagggtaaggattcatttagcctagactgacccccaaatttgcttttttttttttttttttggtttttgagacagggtgtctctgtatccttggctgtcttggaactaactctgtagaccaggctggccttgagctgagagtatccttaaacttttaatttagggctgttgtgatcataaaccctgtcttcatctcattactgctgagattaaatgtatgtactacaatctcttatttacacagagctgggaatggagcccagggtttcctgattccaaggcaagagctcttaagccctcataatgcatttaaatatttttttaataaattaattcattttttttctttcagggatcgcttacacttgagaagaactactgaacagcacgtgcccgaggtcgaggtccaggtcaaacgtcgaaggacagcctcactgagcaaccaagagtatgtgaattctgagttaagaaccaaataacagaaaagtgtcatacaaaaaaagagattgcaatgatattgattgaattcctaatatagaagatgtaacaaaataattaaatctgtaattgaattgtttgaacagaagtcagcttttaccatttcaaccattcctggttgaaatgatacctgatcccaccttaggagggagtgctggaattaacagcacacaccaaaacacctggcttcttattaaggtattcagtagaacatgtgactttttcctgacatttcaattataggagtgttgctaccttcatctctcccatatttttgtggtgattgaattaatcttagagcatcatacaatttatagaagtattctatttttatttttgcatgcataagtgtttttaccattagaattatatattcacagtatgaattcctaagttatggtatttattttgcattcttataaaattttctgcattggtgtgagacattaatgtacacatttggtccttccttataatgaaacttattagttttgagatggatagcctatgctaaccttgctatttttttaaatcacaaaccagagtatccccttgactcttggaccttctccacatcccaagtgctggtattgcttgtgtatactaccatgcctggctatatatttagattcattgaatagtatatcttagctaaaattttaaaaatattttcactaattctttgaatatacacatgtacacacataaatgaatcttggtctttaacttaaacatatttaaaatatactgattactgatgaagaaaactctcaatttaattagtctcaaaactattatcatctcattctcctttttttcccctagagataatcacaaattgttctcatttcagggctttttcatggccttcacatttgtgtttttgaggaggtataagagaagaaatgcagtttgagttctcagtgtacctttgctacctttactttggtacatctgtatattgactttatagaatgcagagtctgagtgctgtaacaataggtacttctttttttgttgtttatttgtctttgttttttagttttcgaggcagggtttctctgtgtagcactggcactggccgtcctgaaactcagagatctacctgcctctgcctcccacctgcagggattaaaggtgtgggccaccactggctgactgtttatttcttatgagactacttgacatttgttttggcatttgggagcagatactgcagatatttattactgtttctgcagatattatactgtttctgtagataatatactgcagatattattgctgtttcatatcctttatactaaaggactttttttccccaaaattgtagacaataggcaacacagcagtaaaatattttaattaaatcacatatataatacatacacacatatatatatataatacacacacacacacacacacacacacacatatatatccttccaaagtgatctgaaaaatacagtgcaattaaaagacatgattaaaatgatttttttgagatagggtctcactatgtagctctgtctgttctggatcttactatatagaccaggctggacccaaaatcactgatagcctcctgcctctaggatacaagatgagtaccactatacctggctaagaatgctttcttaaaataggagaaaataagaaaatattgactcataaaagttgtttatagtgtgtaaactttcaacaactatcttgcaaatggggaaggatgtcttgggtttttctgttttgaggagtggtctattagatgggccttggactggaaattacagcacttttaccttaggttcttcagaatcataggttatgtgctaatagaatataaatctcttggtatttgtttgttcatttcttctgattttatttcctgtttctcagaggttttaccaggtatctctggtggtcttacaattcactctgtacaccagattgacttcaaatttatggcaatccaattgtcactgccttctgagtacttacattatagttatgtgacaggaaatgcctcttgtgttttgctaattttttttctatagagcaataatatacatgactgaataaaattctacatttattgcaatgcacttagcttttcttaggtgtcaaatatatgtatatttttaaagatttatttattattatatataagtacactgtgactgacttcatacgtaccagaagagggcatgtactcactgataagtggatattagcccagaaacttagatataagatacaatttgcaaaacacatgaaactcaagaagaacaaagaccaaagtgtggacactttgccccttcttagaaatgggaacaaaacacccatggaaggagttacagagacaaaatttggagctgtgacgaaaggatggaccatctagtgattgccatatccagggatccatcccataatcagcttccaaacactgacaccattgcatacactagcaagattttgctgaaaggacccagatatagctgtctcttgtgagactatgccggggcctagcaaacacagaagtggatgctcacagtcagctataggatggaacacattgcccccaatggaggagctagagaaagtacccaaggagctaaaggggtctgcaaccctataggtggaacaataatatgaacgaaccagtaccctggagctcttgtctctagctgcatatgtatcaaaagatggcctagtcagccatcactggaaagagaggccctttggagttgaaactttatatgccccagtacaggggaacgccagggccaaaaagggggagtgggtgggtggagaagtgggtgggggagcatgtgggggacttttggaatagcattggaaatgtaaacgaggaaaatatctaattaaaaaaaaaagatctcatttcgggtggttgtgagccaccatgtggttgctgggatttgaactcaggaccttcaaaagagcagttagtgctcttacccactgagccatctcgccagcccatgggcatatatttttgttaaggtttatttgtatcgtatatgtcagcacaacatatgtacctagtatccaaggccagaagaggacatttgggtctcctgggagtggagttaacattttccagaaggttttgaactaccatgtggatattaggaattgtacattcttcctaggagcaacaattgttaaaccatctgtctagcccatcactattttagtttaatctgtgtgcttgtgattgtgggtgtggtatgtggttgtgggtgtgtgcttgtatgtgtatgcagacactttgaaaaatggttattgaactggattgatggctcagtggttaagagcactgactgttctttcaaggaaaggtccagcgttcaattcacagcaaccacacggtagctcacagcaatctgtaacaggaggtgctgccctcttctcttgtatcttaagagtttctacatgaggactcttggctttttagttattaggatacatccccatactgaacaaatatctcatagtttatccatttttgttggcagaaatccctgtttaattctttagtgttatgttcgtacctaaatgacaatattttaaactatgttagactttttaaaggaggctcttttagagtaaaggtgtttataatttcctatttattgctatctacaaagagatgccttctgtcatttaaaaatattgtactctttttgtaggtgtcacttgtacccacgacgttctcagcaacagcaagttcctgtggtggatttccaggcagaactaagacaggcattcttagctgagacaccaagaggtggttaaagcagtattgcaacttcaaggtggtggaattcaaggaaaacaggttagaattaattccaaaatgaataaaagtaaaaagaaagcataaagtatctaggatttaattgataaaactactttttaaaaaatgaatactatatataatattatattatatatataatatatatatataatatatataatataatatatattataatataatatatatatatatatatatatatatatattaatatcctagaatgaggcacacagattttctaaaatgcacatattaaataacactgaaaccagtataactaccatttaatgtatattccctgacatgttgtgtttccatatcctactttggaatgcattaaggaaattttattttctttttcattgattattttttttctactttacaaaaaatacactcatttattagttaatttatagtgccccctcttgtgagattttcctgttaatattttatatagtattgtattagcttttattattttcaagaaagaattatgtttatgaatatattgaattattttaatcatgaatcagtaggcatggaattctacagaaagtatttcaccataattatttctttgaatcagcatatcatgtaataaaagtatcatctataatgttattacaatacttactgtagatttagatttactttatttagattctattttacagtgtagtgctttggttttcttttaagtcagttaatttatttaatttataaatattatgtgtctatggtgctttatacctgtatgtctgtcctccatgggcatacagtactcacagagtacaaggctttcttggacatggtgtgaaataatgttaacagatgtcttatttataaaggttgtgctggaggatggtcttgtcaggcatcagttgtcaggcatcaatgggaagagaggtccttggtcctatgaaggcttgattgataccccagtgtaggggaattgagggcacagaggcgggagtggatgggtgggtcaagggacattctcataaaagcacagggaggtggagatgggatagaatgtttccgggaggtggggaaatgggaaaagggatagcacttggcatgtaaataaaaaagtgtaaagaggggaaaaaagaaacataagtatagttaagaggaaacagaaacaagcaaacaaataaataaatactgtgttgcagctataggtatcatttgtgtccaaggtgttctcagcagcagcagagaatttatgtagtgagttataaactactctaaaatgagactctgtttcacactttggccaagaaagcctggatttcttatctttctgctctatgacttaactcttatatgtctgtactactatatgtgtatacatactagagttattttttacaagtttaatgcatttattcaggcaagatctcattatatgatcttggctgacctgtaatttaatttaaggaggcagcctcataagccaacccaatgcatgttggactgttgtttggctaagttttgtgcaggcaaccatatgtgcttactgtgatagttcataggtataataatcttacaagatcatgaagacactatttcccagaagtgcactgatgtctggttcataatttttctacccattctgtgatggtttcttagacttgcgtggtagtgatgtgatataatttatgtctgagccctcctcttcacttattttctgcactttgttcaattgcaagtctataaagcaccattcattgcagagagaatcttctgatatgaggtgagacatgaactaatatatgggtataaagtatgtagagggcagtcattttatgctataccagtttaacaatagttgtagcttcccctatagtgctgtattctcagctgtattgcatgcattaactttgcctattttattaatttaaaaataaacattaagtatttttacaggaatctacggcggcctaagaaggtatcacaattccctggaactagaggtgtagacagtgttttaagagagcttatgttttaggagaactgaactagggtcctgtgcaaaagcatagtagcatctcataaacagagccaattatcttcctgttttcagtttttaaaactatcaattaaggtaggcatggtggctcttgcctttaatttcaccaatcaggaggaaaaggcaagtcgacctatgtaagttccaggccagtcagcctaaattaggagtttcaggctagtcagtgctatgtagagactctgtgtcagaaaagaattagccaattaaaaatatacaactaaattagacacctgttgactactccaataataaccatgaaatccttgtaccaatggtcctatcctaacagggttcacagcagaataggaatgaattttcttcagcatcctgtatcgcaccttttgacactgaaagctagccagcatttaggaagcttctggcacaatccagttggatatgtctgctctctgcaaataaattatgtagttatcttaagcgatgggtgcttgttatcaggttttggttggaaatgtaaaacaattacatcagtgtatgttatactgaggaggagatagtctgcaccacactgtaccaactcaagggaggtaattcacacctgacagtgggtgctttgtttgatacgttatgggtttggaaaggaacatcttcaaacccatgtaactaaaaatgaatgttttatttcacatacacacacacgtatatatatatatatatatatatatatatgtacttggaaagtttgattgatcagatttctgcattgatagaaagttgtaagccatcatttggatgcaaggaccagaaataggtcttttaagactattgaaccatcacttcagaccatttattttattgatttcagttctctggaggtctttatatattctagacagtttgcttctgtcggatatgacaagcaaaggtattttgcaattctgagagctctctatgtattctacgatgtgtccttttctgtacagaagctatttagttttgtgagtttgcagtattgattgttggatttgttttctgcattaccagagttttattattctttgcagtttggtctatttccctgtgaatttcattttctttatagctgaaaaagaaattgccagcaattagcattgttaaacaaatgagtgtagggtacagtgtacacatatgtcgtagagtggaagagcaggatcagtaaggtttatatacttgaatacagatttaaaaggcaatacaatcctgtttggcatgttgtctatagtttgctctctgacagtactaaataacccttcccttcacattgtttctgttgttttctcttagcaattgtgacaggaacataatgaaatgtaaaatggtttgaattttcatattcctgattgatacccccacatttttatttattacgtatatattatatattatatatgtatgtgttctgcctgcatgtatgcctacaggccagaggagggcacaagatctcatagatggttgagagctaccatgtgattgctgggaattgaactcgggacctctagaagaacagccagtgctattaacttctgagccattttgccaggcctgctaaacacttttaaagatttttaaagatatttctgtttcttttgagaactctattaatatctaaagcctattaataactgggttctctctttttaaatgtatatgagtgtttttacctgcatgtttgtatacatactatatgcatttagtgcctgtgaattacccatgctgaataaggatgaagatagtagtggttcttatttattggggttgctttgagatttttctctatttaggatagctttcattgccaaattgttatagccattgttttgtgaaaccttgttccttaaaatacacacacacacacacacacacacacacacatatatatatgaggtgatgttgaattttctaaatattttgagatggtcatgtgacttgtctatctctacatatgagatttatagatttattgatatgtgtatgttgaaccaaacctatagctttatgataaatccagcttgattgcattggattatgtttttgatgtgtgtttttatttgatttacaggtatatggttcacatgtttattatggattttggtctatccattttttatttgtgtgtctatacctggctttgatgttagtgtaataataacttcataggaggggttcaaattgtaacttgtatttttttgctaatttgagtatactgtcacacctgcccaattgttatttatattggcttctaggcaccctaattcaggcattatatttgggagcaggtactttccaagttgagccattctaacccttatattctgcggttaacactctctctctctctctctctctctctctctctctctctctctctctatatatatatatatatatatatatatatatctttatataatagctatatttttaaacgtatctaatattactcttaaccagggattctttgtatagccctggctctcttagaatagaattttcttggaagactaggctcgtcttaaatttaggtcagtctgcctcctgagtactaggagtaaagtgtgtgccacctctgtccaggtaataattttaatacattttggaatagagacattcatttacacacacatcattattcatgagtttgacgtcacttggattaacattggcagttctaaacattgtggctgattaatgatattaaatggtaagatcatgctgagcttgatgatactttccattaatgccagcacaaagaaggcagaggcagtcagatccctgaagccagctacatttacttctttgagtttcagaactgccagggctatctcaaaaaacaaaacgccaaggaaagatgtcacattgaaggacagcttgctagcctttgtttgtgaaatatgtctcaaaacagacttgttagttgagttactagtgatacttgaagataagaaagaaaaggctataggaagaattaaagtattcatcatagactgagagctacttaaacttcagaataagaaaagcagtcttgggagtttgacatagctgggcatatagtaccaaatgcctttgatcatagcgattcagtgacaggcagatttctttttcttgtttgtttgtttatttcaagacaggatttctctatgtaaccttggctgccttggaacttgctctgtagaccaggatagtgttgaactcatagagatcctttcacctctgcctcctgagtgttgagattaaaggcatttgccaccatttcctggcaaaatgtaacagattttaaattttatacatacatacctttaatgtgaagatggtcagtataagtgttttccttccaagaaagagcatctaattttataattagataattttctacatacagatagtctacaaattccccaaaatataatatgaagcattattatcttaaacatttgttttgatacatttaactaactggcagcttttctgtttgttttgtttggagatatccagatgttttcctatgtactccaggctagcattgaattctaggcattgttctatcctgccttacctctcccaagttctcataggcatttaaccatataagtttttgttgtggtggttatggttttcttttttgttgttgttgttttttgtttttgtttttttgttttttgtttttgttggggagggaaaaaattttatgctttaacgtgcaattagcctttaagaacgggctatattcttaggcctttattgtattttacatttatttttttaatacttaagttttcaagctttctgtaagactgttcctgccataaagccactgaattcttcctcagcattatgtatacttttactgtaactatatgtcagttttcagcttttgtagtttgtgctcttcaatgacacactcattgatttgtggaggaaggttattcatcgtgactttaagaggggccaaaagtagagatagtgataaattttgggaactgaaaaatgtgggtgttttatatatatattatttaaaatattctaatattataaagataaatatttaatgtgaagatggccagtataagtgttctccttccaagaaagaggatctaattttataagcaattgtataaaaacctggtaataatgttttgagatgtctcagtgggttctgtagaagactccctttctagcattcacatggaggctcataactagctataacttaaattctaagggatttgatacctttttttaaaaccttgagaacaaagaacatacataatacaaggataagtgtgcagacaaaacacataaaattataggtgacatctgtgaatcactgctgagtggctagggaggtggatttctcaaacttaaaacatattctctgatcacatgttcgtcacaaaggaaggtagcacttctatttgacctataaatacacccagaaacaaacccagaaaccttaccaatactggtggcaatgggtttcagagatctgttgggtagaagtagtgctaagaaggaggactggaactgttcattgttggacgcgcaatcagtctctaatatactgtttgaaaatggttgatttttaagccatggattgaggtagaaatgtgttttcctctgcaggacccatcctctgtctgtgaaactttggtcaagcttacattgtttgttaatagcctgcatcgaacctttatttatatcccttccccgagtattaaggatcttgaaattttagtgttgacaacggctattgtggaacagcaatcatggtaagttgtacatttaattaagcgaagggttggatagctaatttaatgaccccacatcatagtttctcaatgtatggggttttttatttcggtaaaaaatttgaaataaggatttatctttatagaaggatgcttattcttctgtttagcaatcaagagatggcctatgcttatcctgtatagggtggttaaaagctttggaaagagtaccaaggaatgcatacattatgtaatttttattcaacgactaaatcttttaagggatcaacttgtagatagatgactcttagatcaaatcgcatatcacaaccacagactattgggaaagaacagctttcaatcaacagaaatacagttggatgaagagagattgtcctatagattactgtgattctgagagtcaagggcacagatctataaaggagaagatgctactctcagatttaagtagtatgactcatgcctaaaaccagcattttggtgttggaggcatgaagaataggggctcatggtcctcatgtgtgtatgaagtccagtatcagtcttggaaccctgatcctatttaattttctttaataatagtgatgtgggtctgatggatctgggtgccttttggggtgccagtggatcattgtacattcattgggctagtattcatcgttatttgttgaggtaattttttatgtttacaaaataattcacaggacaaggtgctctgttagaagctcatgtaatcttctagaaggaaagcttgaagttgaatgaaatagcaactataccaagtaactaggttgaaatgttttcagtttaggagtaaatcccattaatctttctagataagataatactttaaggttctgagaagtgtcgatatatttatagtgatcctaattctattttatatttcagtaattggaaaacatttggaaaaaaaactattgaagaaacatggttataaatgtaggcaatgaataagctaatgttagaaaactggactacagattacacttaacattgatgttcccttctaattggcagactgtgggtaagagtagcaagatgctgcagcacattgactataggatgagatgtatcctgcaagatgggagaatcttcattggcaccttcaaggcttttgacaagcatatgaatttgatcctctgtgattgtgatgagttcaggaagatcaagtaagtctgtttggggtcatgggtgtgggaggtaggaaggagatggagggaagttttgagctaaagcaatatacctcagagtgactgtagtgaatataggcactataatgtgtcagttttgctcttacctattagccctttctcaggattctgtcaaatccttacattgcatcatagccattgcatgcatatcatgctggcaaaaatatatctgatgtcaatattatttggttgtagtttctaatagatttatcattttattataattgaggcttaaattatgcctacttaaataggtcgtgtcatgtaatctgtatctaaattgtgaaaaataatctaattttgcatatttctataatattgacgcattcacaggaaactaattttactatttttacatgactaagtcctcatagtaaacaggcaaataaactgttgcttgggaaatgtttcattgaattttaaattaaacttttgataagaattacaaaatgatttcactaatatttatttacttctgatttataggccaaagaatgcaaaacagccagaacgtgaagaaaaacgggttttgggtctggtcttgctacgtggggagaacttggtttcaatgactgtggagggcccacctcctaaagatgtaaggaagatgcagaacaggacatgcatgtttttgactttcatttttaatttatatacaaaaggttgatctataatgtggaggacattttgttattttaatgtatacagtagaagaacactaaaatatacctagtacttaataccagtacatctgtagccttaggaattaaggatttatttttgcttccacctatgcacctatgtactggatactccctaagttatggtaaggaattgacttctttttattccttagggttactctgttttcaaaaggttttgtgggacaactgtcaataattatcaaacagataatatgttttgtccaatcactggaaaacctggacacccactcacatttgcatatatctttatggaaaatcactaaagtttagccttgaacttgtatactttactttttctagtgtagtaagaaagggcatgcattttgatttgaccaaagcaatgcttgtactctgatagcaacagtccacttttactagaaggtaaagtgaataaaatatctataaatgaatttttttttgagaagaagttgttcagggtttaccctgtttatgtttatgcaagattatacagtctcattgtatatattcaaaatctgaagggttcagaagagtatttgttgtattacaccatcactttcatttgtatataaagtgattggagataggtgttttgtaaaatttagttacagaatttgtctttcaataaatgaaattgtgaacaaactcaacatgctatgtaagctatacatttttgttttagactggcattgctcgtgtgcctcttgctggcgctgcaggtggccctggggttggaagagcagctggcagaggagtgccagcaggtgtacctattccccaggctcctgctggattagcaggccctgtcagaggagttggaggcccatcccagcaggtaggaatcacaaaaatgttttctattaatgagaaaatataagtagagcctgagaatgatgaaatgcggaagcatgaagatgtgtctatactatttaagttgtatatgttctaaaaagatctgatactcaactgtaaatggaagggacttatagttgctagcttaaaaaaaaaaaaactttgattttatgtcattaaagattcagttatatatgccagaatgaagaaaatcacaagcttagaaaatgttaatatgctaagatttaaaaacatgagactaaagctagatgtagtagtgcatgccttcgctgtcagcattgtgaaggctggggcagatacatctcaaggaatccatggtagctgggaatactagatggagagaccattgtcccaaagaaagaacaaacaacagaagaaacaacctaccaacaaacagaaacccacaaacaaaacaaaagttccagactgttgcctcagcagctcagaaggagtatttgcttattatgcataaatccctggatttattctctattaacttaaaagaaatagaataagataaataagacacagcaactacatttgtagtagaacatatttagtattaatactctttttttggaaaaagagacttatcactcacctttcgtcttcttggcataacttcacaggtcatgaccccacagggaagaggcactgttgcagctgctgctgttgctgctactgctagcattgcaggagccccaacccagtacccgccaggacggggaactccacctccacctgtaggcagagcaaccccacctccaggtaagggttttgtgatgaataataatgatttggcttctgattctataaccttgaagaaataccatcttaagtattctgatggaggaaaaggcatcatctcattgtcttgctaaaaatttaggaactattgaatttcagggctacttttaatttcttatgaattgaaatagatgtgtttgtttttgctttttttgtttctgtttttttttttttttttttttttttttttgagacaggttttctatgtagccctgactgtctaggaactctgtatattcaaggtttggctttaaactcatggaaatctatctgcctctaccacctgagtgctgggactaaaggtgtgcaccaccactgcctggagaaaactgtgttctttctaaatatatgctggtgaaggtttttttctatttcttcattcacctaaattgacacactttctttactctcaattggaatgcaaaccagatttggccaaaatgaatatgaaacagccaaagtaccaccccccaaaaaaaaaaaaccaaaaaacccacaaaacatatactaagacacattcctctaacacataggaaaccaattaaaaacaaaacagaaaatatagtatttaagcaaaagataaaatgtagtaggagttcagacaaaggattatgagacaaactccacatatactatagagatagtatcgtttgccatcaacagataggcatgggtttccctttaagtgtgttgatatatccattgagactttttttttgcaagtggttaccaactagagatagcttaatgggtaggatgggagcttattttcacttccacttttagtacagtgacccagtgttacttagacaagtgcaagcttggtaaaatactacatgttcttcagtcttcttgctagacagacctctttccttggtgtcatccatcctcactgactcttcctcctcttcagtagggttcctgaggacttagttcagggatttgaaggaggccccagtattccaaggtctctgtacacattttctgcatgttggtctctgtatttgtttccatctattggaggaagcttctctaatggcttcacaaatcaccgatctagcagtgtggcagaatgtcattagtgctacattcctttagcagagccaataattcgttgtcccctaggtttgtggtcaatctggtctcaggttcctggccatctaaggagctgtttgtgattagtttcatctcaaggagaggaagttaaaccatatcagataacgcttattcccacaagctttgtcgctatcacagcagtgcctctttcaaccacgtcacctttttagatcatttggttgatgattggttgacatttgtaaatgaaaggttataagttatttgttattaatgtggcactcaagttttatagtataagaaacttcatttctcattgccattgttggctcatttctttaaccactttttgttctgaattgtaacagctttactgagctgacatgaagtgtttacttatttttgtcaaattttcaggcattatggctcctccacctggtatgagaccacccatgggcccacccattgggcttccccctgctcgtgggacacctataggcatgcctcctccaggaatgagaccccctccaccaggaattagaggttagtggttatgttaagacatccaggtccttcactatttatatgctcttaataacattaatggaatttttttttaatttttcctttctaggcccacctcccccaggaatgcgcccaccaagaccctaagatacagttgataaatctcagcccttctcttcccctacaatgcttcttgtgaaattgtgtacctgcaagctttttgacccctcttactgcattaactatagataataaatacatagagcaattcaattggggtttttctttgtctgctgattttgttaaagttagagtgaaaccaaatgtgtttcagtggtgaaattattgttaaagattactatattaagtttatattaactaaacacagatatgacatttgctcaagctaggttcttaggatcagatagttgaaatattttcctgatttctgacattcacttcaagcattggttcaaaatcttacagataaggaaaatcaagatccatttgctaagatttacaagccattccggttcaattaaatatgtttcacttaaaggtgtgtgaagatatttaagcagatatttaaattcacatcatttatggcactggtatgtcattattgcttatgaattaaaacatggaatgcaaggtattttccaatcttccaaacatgctctattacttagcagtctataattatgtttacaactatacatacatccatatacacacatacacatgcattccatgcatgcatgcgcacacacacacacacacacacacacagacatctatcatgtactgggtctattttggttttagtttgtacatttgtttaggtgcattaattggtattaaataaattataaaatgattttcctgaagaagacttattctcagaagtcaatgatagttcatctgtgtggggccttatgaaatttccagtatccgtgtcagtatgtctgctgatggtattgcacagcttctttcatgtctaggagttgctaattaaccctccctcccataatctggaggttggtaaacaggaggctctgatatttggatgtgagtgatgaccacaaatttgaagaaaatctatgatcttattcttgaactaaaagtgaccactcagaggtgagttgtgaaatgaacattgttttgctagtgtagataccagtctaaactatggattatagacaattaaaaacacttttcttaagaatttttacaagttagaatttacatcaacatgccagtctataaatgtctatggaagatcttttgatgagacatctttcagtttccattttaggggaatttgatgcaaggcctcatatagcctaggcttacctcaaatttcccttatgggcaaagatgactgcactctcatccatctgcctcaatctagtaagttctagtattacaggtatttctatcatgccctacttcatcctaattctaatatatagatgagcacatgtgtcttaaaacagtttgatattagctctctgatttcttaatatgcatagttatttttttctgaatccttaaataatttgacatcatttatctttctttaccagagcatgaagaggcttattatagaaacaatatgacacaaacacactttggaatgaggttttgtgtgtaggatagttcagtctagcatgtatgaaggtgtgtttgattccacagaaacaagccagttgcattggtgcatactgaaaattgaggccaggagatcggtagtttcgaggctatataatgaaacccagtctgaacataagatttttgaggattacttggaaaataaagattttcaactttttagtcattaattattatagcttagtttttgaaagattgtctgtttatgtattggaaactggtttcctagaaactattatgtattataggatattggtggtggaagtgaattgcacaagttataagagacaatgaaatagttgtctaatattttacagatttgcttctgttatatactgatttaaacaggttcattcagttaaaattttgaaattgcttcttagttcttttgtcaccttcaaagaagctgtttattccttttctttatatgtctcatatcagaacatggatttttttttattttttagaacatggattttataaaatgtattaaagcctgctttttgtagaacagtatccaatactgaaatatgttatatctgtattcatattattttagtctcatgtgttgtccttctgtcaatttagttcatgactgaagaaagaaattttcagtgaatgttatgaagtttcatgacttgactaccaccctgtagtattataacaaagctgtaaatcctaatatcgcagcttaagacagaaacataaaccatccaaggtaatgtaatcttttgttgaaaaataagaacattttacggagaccttgactggatttatgatgatataggaccttgtctgaatataatgatttcaaaaattgagcttacagtgactgaaatctagtcaatgtgcctcaccctagtggtacacacttgtagtcacagcacttgggatgctgtgataagattgtgatttccaggccctcttagaaaaggaaagcaaatgatcagatttgaagtgagaacattgcatactccggaaaaatggtgtgcaattttctattttctgtaatatcttttatataaatatttaaaagtaatttgtgggcttttcttgcattttatatttgttgaaagcaagatgaaatgtccttggatcacaaaaggcctggtgacatggatcctcataaaatggcgttcccaactcatgaaaaaaatggagagccacctttctagatttgtaaggtatatgaatcaggaggaaagggtaatgtttatggagcatgtacattgtggaatgtggtgagtatgtcaagctgttcttttggtggctacatttgattagccagtgtcactgtagaattattagctgactatatagcagttcttccttattttagaaagtattttaggtattatatacattcttggtatataatattaagaacccatgactagttggtagttgcatccatattctgatggattatctagctgacaattctttcagtgcttaaatatttccctgcctttgtgctgtgactttttttaaacctcctcattgacatttacagtgtattggtaggaatattttagttatctttgattaataggtaaaacacaaatgccatcacttttattagagtagagaatctttacaagcttaaatgggatatttttacttaaaagagaaaggtagtaggaactaggattgacctgatgagcaaagtaagtcaattagggagtgttagagaaccatatgctaagatgtttaagaaagcagttaaggggctggagagatggctcagtggttaagagcagtgactgcacttccagaggtcctgagttcaaatcccagcaaccacatggtgactcacaaccatctgtaatgagatctgatgccctcttctggtgcgtctgaagacagctacagtgtacttagatataataataaatcttttttttttttttttaaaaaaagcagttaagggaaaagaggaatggttcttgggattaaacttaggatttcagataggggattatgtgtatttacctgtagaacagtcatactgactctagagtagtgggttgttgctgttgggatatctgtagtagtttaaaaatgacagtggaaattacagagatgtgggattaatggcatgcataattaatgatatccatatcttttaaaaatagtaatttgttaaaagcacattttaaaagtttttgtaatcatcaaaatgttcagttagacataagggtgttaaatgaatcactttgaaggtgggtaaaaataccacagggtagatagtttgctttgttagaattggctattttttttatgctgaggtttaaacccaagggcattgtatatagtttctttcttagggtcaaactgacaagtcaggctgtgtggatctgtttggtttcattgttttgttttgtttgggtttttgtttctttgttttgccttttgacactgggtctcattatgtaactgagtcacactggcatccaattcataatattcctgccttgctgttgcaagtgcttattttataggctcgccacacacctattttttcattcactcactcattcattagtgtgtatctgtgtgcccccaccccctaccgcactccaaaggacatactttctgtttaccttacaactaactacatacttagccaggccagactatattatttttaagctgtttatctagctcggagttttatgtgaagcaatagctttgtaatgaacgtgttctcctaaatcttgaggtttttctctaacacaggcctctaaaactcatgtttctactatatcagtaccatgtaaccatataccactttccatttttacagtttttttttaaagtcccttctgaaggactttggctggacttatgatgagctatgtttactgagcatgatgaaatgatgctcaaaatgattactctgaagtctagccaaagtgtcagtttaagaacttaggtaacaacttaagttctgggaatatgaaacaagatttttttcaaggagactggagctgtagatttttccaatatagcaaaattggttttaaacctatttcattttatttttgtaaagtgcctttgtgtttctaacaccatagctttttcacctttctttctatataataaattctagaaataaagaacttggaagttagtgtatcgctcagttacccaaaatgtaccctgtgtgatagtttcctgagcatgttcctagccattttgaatgtattgttccttgatttttttttataagataggaattttatgttttttcccaaatgctgaggataatccagagaggttaatctatctttattatcataaagcattgatggagtagtcactctgtaattgccaatactgaatatgagaaatatttggtaaattttgtttaattttttgctagtgagatcacgtactattcctgttttcaaacacgtggttgggtggtgtcaggataatcatctgcataccagtttgattttgttcctctgaagtgtgagtttccctgagctttgtatgttagctactgctgtagtgattgcttgttgtgtggtatccttctgcctttgtaatacttacttctggatctttgcatatctacatgcatacacagcaatagatttattttcctatataattataaaacaattcttaatctgttggttatggcaaatttattgctgtgatatagctttgttttaaatatatgataactttattggcataatttagtaaaacatgtgaaatgatgattataatatcttacatggttcagcgataaactagaaagatacttttgtaggactttactttttggttaattagtaaaaatcagttagattttgacctatttgttaggttaaggtgttttaaatggaatgatcttataaaataactaatcacagggataatttctataatgtacttggtaaatgattttatagaatttatgggagacatgtcaatgtttgagtagttaagaatagtgttaaacaaggggctataatgtgtattaaatataaatagaaaaagtcatcattttaaagtacatttgagaagtcattccagttttatgggttgcattttcattttcattttctttttctttttttttttttttgcaatggaataagagtttaactgagggcataaagaggggaagtaagagggtggtagaatcagaggcggtagaggagaagagaatctattacttctcttccagccaggctatgaacatgtggagagggtgggtggtggccaggaatggagaaagaggggaagggaagagcaggggagcaagagagcaagaaagaagaaagagcagtttggcattttcttgatatgaagaaatagaagttgaattcctgtagtattataatcttggttagtgtggctttctttcaatgaacagtttttattaatttttttaacctttgttactatggagttttgttcagcatgctttgtaaatagaattcttggttcttcagagaatcttatgttactttatataagagaagtttttttgtcatgatacaattacaaaatacatcctgttatgacatctactgttatatagcataacattggcctacatacccaatagtgcaccatgttaatttaatcttgtgaagaaaagtaatggattgtgttttgcaagatacttaatgataatgaaatttctagacaaacaaattacaaaattactagaatgcttgttctggaatttctagactttctagttttatggcaagtaaagaaaattcatgacataaaaccatttgtaaggggtgatctatgtgacaacttcacatagttttactccaataagaagttaataaatattgtgagtgaattcaatgttaacacactatacccttaatatgctaatacatatctaaaagatacaaaatcatttaaattgaataagaaatttctggccaactttgttttcagatttattttatatacaaatacacagttatttatatcacagaaaaatttttatattttaaattggaattggacactgaaataaaagattagaactttggtggtcaacagaatatattatatggattcttaagtagtatgatacagcaacatttctctgttaagggttaattaggaaatgctaagcagaggaaaggtattcttttttaaattggaattgctggatcatactttgaaattgccaatttagtcaagcccatctgtcagtctaactttcagcttgtttttgcctgtatttattttaaatcagacctgacaggattgataactgaaaaataatagagtcctatctttgtagaaacaaaagtaccttcaactgccaaaaacacatggcattactctatatgtttaatgagtagaatgtttgaactgtgtgtagtgactttgtttaaagaacttgcttaatagagaccatgttaacacattatatttcttgtatttatggatagctgtatttaaaaacatttggccagttttcaggtttttaagttgttctgtatgaaaagacatctttatttttgctgttaaatgttactggacatttatgtaaggctcattgtggtggtgtgatagtaaaagctgaattacctgagcattttattaaaagctctctctctctctctctctccctctctccctctccctctccctccctctctctctctccatatatatatatatatatatatatatatatatatatatatatataaatagtttgtatattctttaatggcatcaaggtagttatttctgaggataattcaagtacaagaattatagggtcactgttttctgaaaagtatgtatgctatataaatgacattgaagtttcattttatttttctaatcactaaaatgtgtgatataatttatttttccaaattatcaaggtatatcagaattccatgctttgtagttatctgatacatggcaaaaatggaactttctaattcgtacgacttttataccaatcatctagtagttgcagaaatattgagactcataatttttaaatttataaatatattgcaattcctattgtcttttacaatgaagatgacacattgagagttgataaagcgatcatggagctcagaatttttcgtgtttgtttgaatcccagaggagcaatttataaacactatatatttatttactctattctcagaacagttgactgttttgtcatttgaattacacatttcaaaaaaaaaaaaaaaaagaatgacacattgggtattcagttgtctttctgagacttaatgaggctaatgattcaaagttttttttttaaataatcaacattcatgaagattttgtactacctcttggaacacatataaaattttgtatgtgttcccttattgcatgacaatattcaagacaactttgtaaataatagtcaaatacaaaattttaacatctagtttttctagatgtatagagtgtcacagggtataattttgtaaatacatcagtatgagcttttatgctttttaaatttttttgagtgtgatttttaaaaattgatcttgtttgttacttgttaataaataacatagaagaatgagaaaaagtattttaagttcaacactggctactcatctactggaaaaatttcattaaccttagtgtaaggcttattggacacacaaaactatttataatggcatacataaattatagtcatgtggttgtagtaataaaaggtcattatctaaacatttgtatttaggcattataggaaatatgtcttggaagagtttcgtctacatttgtgattgagttaatacagtattatatttacggtacatgacagcactcaagacatgctgtaaatatatacatatatttatgccagtttgaaatatcttttttacagatgcattcttaacacagtataagcctgtaaatatttcattatgacctaacattaattaaattataccagtaaattcttttacaatggaatagataaatactattaaaatattaaatataaaactgtttatgaatagtttctcatgtagagaagaacaagccagtttttctatactgtttacatgaagcaaaattacaggaaaaaaattgggtgctttttatctccaagatagataaactatgaaaaactattaataaattttaagttaattagaaaaattttcaaaatcattgttagtccacgatttaccattggcatgcttatttacttttacctgcagtgattgcattcacatatttaggtcataatagtatatagattaaatacttttaaattatgtttatattgtggatttcaatttatattctggtttacaacttataaagatagtatttcatttataattcagttaattctgcaatctcaatgttatgactaaattcaatttgtggtaaatacatatcctgtaacttttctaaatgttttaatatgtttatatatctttaagctattttaaaattttgtatattttcatctagtattattaaaggtaaatacctagtatagtgtacgaaaaaacagcctgtatcacattaaaagcaatcaagagaaattaaaatcagagttaggattaatgagtaacatttatcccagcacctttcaagattatacacagctccgtactcagtttgtggacagcctgagctcatttggccttgtgtcaaaagaaagtgtgaaaacagaaaaactgaacacatcccttcaacacaaaaggaattgtaagaatatgtattatttgttgcaattttagagttatctcctaatatttcatcatttgtgattctcaaatgtaatttgattttttttgttggacagtaagatagccaaataccagatctacgaaaagaacataaggattgcagcttaaggtgaatgtaatttaacagtgaaatattctctagaagaggggtgttgtattataaattaaaaaaagaaacaagttgccttcttgtagacatactttagttcatactaaaagagatagttaagaaattcctgattatgcatatgttgtgtcattaaggaaattaatacttttgtatcataatatgtattattttacagtaataattgaagatttgtgcaagtcaattaaactatacatgcttggaaattgccacatgggaccatcttgaatgaacagtttatgcaaacagaaaacatgttcaggaagaatgttaaaattttaacacttgtaaatagaaagaagatgacatttgcctgtctttgtaatttatgagggtatttgcaaataagcatcaaaacaagaagaaaatattaaaaagacattttgtgccaggacatcatggtagtgctggattgcctatccaactctgtataaaggtttttcaaacaatttgtgaagaatgttagtatcttcagagtcttctgcatcagcaaagagtagtgcattaactaatggaaaagagaagataaaatttctggtaagtattagtgacacatatgagtgaaatataatgttttagctaggatttaatgctgtgaagagacaccatgaatgtgagtatccttataaaggggaataattggtgctgtcttacagttttagaaaattagttcattttttgtcataatggggaacatggcattgtactggcagatatggtgttggaggagctgagaattctgcatcttgatcagtaggcagcaaggagtgaccatgtgccctgctgggcattgctttagtataggatacctgaaaacctgcccctgcaaacaggccacatgtcctaataatgtcatttcctatgaactgaacatacaacacatgaatctatgtgacaagtcctgttaaatgtatcacacgtagaaactaaaaagtattcagcaataaatattggtaatgtcagtcatgcttatgaatatagcatgctgtatcttatgtttttgttatgtctcatttaggatgagttgcaagttgtctactacatttttcttagaatataactcaggatcagaaacaggccgaaacacttttccaatcatccaaattactttttttattaatgagacatggctgttctagaactcactctagaccaggttggcctcaaccccgaaatcggtgtcttccaagtgctgggattaaagacatgtgccaccactgccaagcctgtaaatatataaattatataaataaataacaggattgtgcttactttgttggatgtgtttgatttgcctgagggatttccagtatatactcatatagatatagatatagctagatagatatgtatataagtagatagatagatagatacatacatacatacataattctttcaaatgtacagacggatactttaaatagtaacataatttaaataaaaacttggagtgttcaagaagataatttagctgttatgcacaccaactgtatttattaatgaccttaggtctgttcccatctatcagttgctgcctacaactacagctccggtgtacatcttgcctcagacacctgtcccatgtacaggtacatgcacttgaatgtaaagtaagatgctagggtcaaagctaaatttacaacatacagtacattttcagaggacttaagttaggatttcggcagctaatcacatctatcttttgtagtatctgaaacctctgctctatgagggctcaatggaaaatggatagaagcatttggtattaaatataaattgttttttttgttcaagaccaggctaattctcatttttttttccgtatacatcctactctatattgggtactttatttttcaggtgctcatgatgactagtccgaacctgtgaacttctgagaaaatttacagttctgaaaactagaggtaagaaaggatttgagtttttttcccccattaggtcaagaaaggtaatacaatttgaaacattcccatgcattctaattttctgagttaaattaatttctttgtgattggtgtggaaattgggcctcccatatactaaaccaagtgttgcataaagaaacaacaactgtagtttgaatcagtttatttttaaaaattgttgagaggtgtagtaggctatcatcaaataccctatgtggttgaggataaaggtaaacgtctgattgcatgccttccagtctcatacactgggactagagatatacttactcattcctgaactatgcagttgcaggaattgacgcatttgttctttccttaaaagtaccagctaacaatattttcagacctttcatcttaataaaataatgattccatacatggatgcacattatcctttagttaattgtcttaatatattccaatactccaatagttacttcacctatatcttagttaaaaaaaatgcattaacagggctggaaagaagatggctcagcagtaagcttttcttccaaaggttctgagttcaattcacagcaatcccagggtggctcacaacaatctgttatgggatctgatgctctcttcttaggtgtctaaagacagccatagagtactcccatacataaaagaaaatcttcaaaaatctaacagtacaacaaagcaaacacaagattaacaaagttctagagatagtagttagtgagtattctttgtgcaaagtccccaattttagttcctagcatccatgcattgtaactcctgagtatcaaacatgggcacaagcaaagacacatagttaaagtaataaataaatatttaaaaacttgacccaagcaatgtgtatttatttggcttcaaagtttaataggcactcaagaatcttacgggagagcatggcaccaggagcatgatgcctgtggtcactttatatccttagccagaagttagagaatgatcatagggataagagtggggaaaaataggttcaagatacaatctataattatagcttgaaagtgttgtgtttttttttttttgtcaaagtagcaaggataattactgtatacaatgaaaattgaaataactaaacaaaacagaaaactgacagcccaaatcagaacactaaagagtaatattacaaattacctctctaagtaaaatcattttgaataaatgagataataatctcatgtcattcaaaatatattatatttttataataaaaatgcataaatgatgctctttgataatgaaataatagttgtgctttttttcctgtgttctctctcaggtggttaccgaattgaatagccgttggttctacagccactataatgatctgaaaagttgaatgtgttgcatgaacactttcaggaatcataatagaactcagctaattagatagagactggaatgttgatttgaagacaattactttataaagattttctcattgctgcttttgcattatcccaagaagtggagacactactacatggataagaactgtatgattgaattgactttggaatcatctcagtattgtcataagtatgaagtgtatttcatggtacttttgaagttagttatagaattttttcaattgatttttctatttttcaaagggtttaggtaatatgtagcatagtctgacttgagtggtaacattttagaaatataccaggtactgttagggcaatattgtgtgaagatttacttttatagtgcatgccaaattttgggttttctggtacattttattggattttatttattaatatttgttataagagcagctgattatgggttaagatgatagtattacagttatgtgtcaaaattctattactttgaactacattggcttggtatatcaagtctacatttgattaaatgtagacttagcaggattaatgaatttggccattaaaactacaggaattttagtcaacattcctctcatatttgtgtatttatgtatgtatgtatgtatgtacaggaattttagtcaacattcctctcatttgtatatgtatgtatgtatgtatttatttatttatttattatcaaatcatgctgttcatttctgctcattgtttgagtttccatgctaattatctattattcataagtacatttataaataagtctgtaagcaggtcatcatgtatgtcagataaaatactgtgttttctactctctgttttattactaagttgtatatgaattatgcattaaatacagaatgttctctcttatgtcatagtttgtgtttttcttttgtaagcatctttttggtcatgtcatacttatgtgtgttatctccctagtttttcatcagatactttgcccttccttttcctcattattagtgtgctagaatatttaataatgcatattttaatagtagtattacttctcaaactcaagcatattagaacacaaaatttgctttatgtctgttttctttctatgtttacctgttctatatagttcagactcttttctcttatttttcagaatattcactgtatgtagtcaattttttcctcagagttgatggttataaatacttgtcaagttggaaaaattcacttttacttttatttgcatcacacttactagattagagactagattgctttaaattgagtcttcatttacaacttcaaggtatgtctttctctttgtaactaaatgacttcgtacctgtgcattccatatatttcactagtataatgtctggtaacatcaagtcaatatgttggtatatgaaattcattttcagatctttacccagtagtctccattaaatttctaaaatggtgaagtccttactatcatttgatcatgagtaaaaggattaggaattatttctagaatatacaagcatgaggtactgttatattttcttattaatattccatactggttttttctgcaaagtctctattggttcaaatgtttttggacttaacctatcttgtttaaactatagcctgggacacattgcaatctagttcaggttgaaattgaacttttaagaatccatttcctcagcacctccctcaaataaagttaacatttttgagagttgagtatttttcaattttattctttggcctatagagatatctaagcaattcagagtaattactacttgtacagattaattccattactggcacctattttaggctgtatatttgcctgaaactgcagctacagttgcaagatacaatacctctcctctctgggaacttagactcatgttcacatacccccatacaggcacatagtagcaatatttaaaagtatcccatttaacaaatctgaattcctaagcaactgcattttttgtatgtttgtatttgacattatttctgtgttttttcctgaggccatttaaatggaataatttaactagattatagcttgttaaacttaagggtgtaatggtataaacttacaacctctttttgatcattatgtaggactattagtactttgatgccagactggataaaggctctcccaaaattgaacagtaaacgtaaacgtttaaagtagttgtgtacagaattttgttttaatcttcatcatatgctgaagtgtttacctaagttcaggaaataatattgatatatcaatactaactaatatataagccttattcatatttgtgaatcttattcagttttttattactaatgtaatgattttttatgattcatatttgacacacgtatcaaaaaatagtaaaacagttgtgtcattcttaacattttttaaaaaaagtatattatgtataattttcacatacaatttaattttaacttatttgtaaaaaaatgtgggatttatattttggaaatatttctatattcctcattttaaaatatgcacttttatcatgctctcctaacatgaaagccttaccacttttgtttttgtttattggtctattgatttttgttagtgatcctgcttacagcactattttttttaacataaatcaggctgtgccactgtatcacttcttcctagcaactattgattgcctatagatccccaagaagtgtacggttatatgaaacacaccccataaataatcgaacacagatttatgctttacattctccatctatgggtgctgtgaagccatttttacagaagccatttcatgtcccgatggcagcatttgtgagcgctttgctcttaaattttgaaacttacctttcaaagccacttgctcaaagatggttacagctcagtattgactgtttcactgatgctaaaaagatgcttctcttacatgaaataaatttagaagcaattgtttagcttaactcgttccatatttgtaccatttggctcattgtacttggaagtatggttggttgattgctgtgaacaagaatgaatttgtaccacaaagcactttccatcctgaagaaagccagtatagattcatttttcagtttctgcgtgttgaatatgtatgacctataccaaaaacatgtggtataatctgcagcatgacaataactggttttggatgacaaataagagcagtggcaagttgccttggagtcttactgatatgaacatacatataataagtattttatatcaggtcctgggttttgtttatatacatatacatatacatatacatatacatatacatatacatatacatatacatatacatatacatatggcttctggaatcacccttttccagatgtcagtatacataaaaacatttcaaaaaaatctgtaattctacttatgacatgttctctccttcaatgatagaaccactctaaattctagtattttcagttaaacccaaattaaaaattcaatgtgtgataaatagaaaacaagtaatttgtgttcctggaacttagattcaactcattctacagtttcagccattaagaagtaaaattggtttatttgttaatatatactattttgactatcaagatgggatcttgaagtagatccatttcctaaatagtaagagtatcagtgaacatgaatgaaattatatctccagtggtcattcctgtaggaagagtaatattatattttctaacagtttttcacttggggggagatttctacactgatttccttcatttctgaatcagattacctcttaaagctgaacaactttccttatcacctttcattcattcgtgtttacaataggaaccattttgatggcattattaaatttaaaggtcaacgtagttcaattttcatttttctgaagtctgggtattgagcatctttaaaataccccagtttgcttccaattttttcatatgacctttttaaaaatgtttgatatttaataatcttcaaggtcaatatttccccccattctgtaacctaccaatttcttttgacttgtgaactgtaagccataatacatatgctaagaacctgtgaggtcaagaaacaaaaaaccagaaaacatgagtcgaataacttcaaggttgctattgagtttgttttgtgttggccatcttctgatgtacatgtgacttctgctaagagtagttttcatcagtgagacttcattagagaaaaatgacttttcatttgccagctattataacttggaggtaggtagcttcagcattgaggaaacctgtgaggtcaagaaacaaaaaaccagaaaacatgagttgaataacttcaaggttgccattgagtttgttttgtgttggccatcttctgatgtacatgtgacttctgctaagagtagttttcatcagtgagacttcattagagaaaaatgacttttcatttgccagctattattattataacttggaggtaggtagctttagcattgaggaaacctgtgaggtcaagaaacaaaaaaccagaaaacatgagttgaataacttcaaggttgccattgagtttgttttgtgttggccatcttctgatgtacatgtgacttctgctaagagtagttttcatcagtgagacttcattagagaaaaatgacttttcatttgccagctattataacttggaggtaggtagcttcagcattgaggaaacctgtgaggtcaagaaacaaaaaaccagaaaacatgagttgaataacttcaaggttgccattgagtttgttttgtgttggccatcttctgatgtacatgtgacttctgctaagagtagttttcatcagtgagacttcattagagaaaaatgacttttcatttgccagctattattattataacttggaggtaggtagctttagcattgaggaaacctgtgaggtcaagaaacaaaaaaacagaaaacatgagttgaataacttcaaggttgccattgagtttgttttgtgttggccatcttctgatgtacatgtgacttctgctaagagtagttttcatcagtgagacttcattagagaaaaatgacttttcatttgccagctattattattataacttggaggtaggtagctttagcattgaggaaacctgtgaggtcaagaaacaaaaaaccagaaaacatgagttgaataacttcaaggttgccattgagtttgttttgtgttggccatcttctgatgtacatgtgacttctgctaagagtagttttcatcagtgagacttcattagagaaaaatgacttttcatttgccagctattataacttggaggtaggtagcttcagcattgaggaaacctgtgaggtcaagaaacaaaaaaccagaaaacatgagttgaataacttcaaggttgccattgagtttgttttgtgttggccatcttctgatgtacatgtgacttctgctaagagtagttttcatcagtgagacttcattagagaaaaatgacttttcatttgccagctattattattataacttggaggtaggtagctttagcattgaggaaacctgtgaggtcaagaaacaaaaaaccagaaaacatgagttgaataacttcaaggttgccattgagtttgttttgtgttggccatcttctgatgtacatgtgacttctgctaagagtagttttcatcagtgagacttcattagagaaaaatgacttttcatttgccagctattataactttgaggtagcttcagcattgaggagtgagacttgtttctactttgattttcagctgtgggaggtcaactgatgtagacacacatgtcccatgtgcttgatgctacagttttcatatgtgactaggttatgctgtatttagaaagtcttgatccttggtgttctacataccctctgatttttacatcattctgtctcttctgcatggttccctgagaagtgagggatggaatttgatggagacattctatttagctttgtgcattccagggagttttttaattgctcttttcagcaatggtacctttatggcgagtttgggaagaacaacataatctttgtggtagcctgggttgcttggcaattcccattggacccctttgtacaacaactcaactacttgtaacacaattccagtaattgaagattaatttgattataagagattgccagttcggcctctgtctccattatttggtgacttcagatagattatatcccttttcttggtccccacatagtcattactatttaatctattttcctttctaatccctatattggaattttcatttggtgatgagagatgtccagttgggaatttttgtcttctgttcttcggtgatttcattaagattctgttcatacatgttctgtgaggggttgtactaaaattttgatggggattacactgaatctttacattgattctgaaaaaatagtcatttactcctaatgatccatggacatagatattttcatcttctgatatctttctacaaggttttgttatactttgtttcattctgtttctatttggctgacttctgctctgagcttgactgtttcctgcatctagtcctcttgggtgtgtttgcttttttttttttttttttttctagagctttcaggtatgctgttaagatgtgagtgtaggatctctccagtttctttatgaggacaattagtgctatgaatttttctcttaccactgctttcattgtgtcttataatttggtatgctgtgttatcattttcattgtgtttcaggaagtctttaatttctttatttgctctgaccaagttatcagtgcatagagagttgttcaatttccaagggtatgtgggttttctgtttttgctgttattgaagtctagccgtagttctagccgtagttcatggtggtttgatagaatgcataggatgatttcaatcttcttgtatcaaagggttgttttgtgaatgattgtatgctcagttttggagagggcaccatgaggtgttgagaagaaggtatatttttgtgttagcatgaaatgttctgtatatatattattaaatccatttgtttcataaattattagtttcaatttgtctctgtttagtttctgtttcattgacctgcccattggtaagagttgggtgttgaagtctcccactattattgtgtagagttcaaagtgtgctttgaacttgagtacagtttctttataaatgcgtgtgcccttgcatttggggcatagatattcagaattgagcctttctcttggggaatttttcctttgatgagaaagtatcttccatcttgcttgataacttttgaaaatctattttattgaatgttaaaatggcaactgctgcttgattctttggaccatttgcttggaagacttttttccagccttttgctctgaggtagtgtctatttttgtcatttaggtgtgtttctcgtatgcaggaacatgctggctcctgctgtatccagtctgttagcttatgtccttttattggggaattgagtctcttgatattgaaatattaaagatgatggttgtttctcgtatgcaggaacatgctggctcctgctgtatccagtctgttagcttatgtccttttattggggaattgagtctcttgatattgagatattaaagatgatggttagttctgttatgtttgttgtaggtggcatgattaatatgtgatgctttccttttgtttttgctgtgagataattaatttattggtttgacttatgatacattaatgaagaattgttttttatctctcctgactaaaagcggttaaataccattttttacattgtagaatttttatgccagctaattaatttgttcattccattgttttggtaagggtattcaacattatacactgagatagtaacagtcttttagtacaagatatgtttcttggagactgctactggatgaaatcttttcattaatataatagctcatgaataaatacaaagtatgtttcttatttatatccttttagtctcatgaactccttccaccatcttgtcctctttgtgactttagcatacctagttcaattaatgctgcctttttagtcatatgtgtgctgtgtgctgctccgtcacttgggggacaattgaccattatgtttattatgtgtcatgtattaattcctataattttattgtttgtgatactttcttagttctcattttgttatataatttacttttttctttgtgcctttttgggtactttcacctttcattttaggatgagtatttcttctactgccctatatagggtcaactttgctatcatataatcctttaatctgcttatgtcatagaatgttttaattaccattccaatgtcatagttgttttgctgagctaaataactgggttcaaaaatgtgtcctttgaggatttgaattgcattttccagtacaattctgctttttttgttttctgataagcttgtttttatatatacccttgtgtttccctatttcatttttcaatatatcatttttctgtttgtttttttgtcacaaacctattttctgttctacatgtatcttgtctcagaataaccatcctttccttcaattggagtatatttttttactatgatagtactaaaaatattttctatttctttttgcatgcagtttttccattcctctatgtccataattcataccttcaggatatatatatatatatatatatatatatatatatatatatatatataaacttaaggttctccttgacgaaattaccaaatttctgccgtgtttccttccttccttccttccttccttccttccttccttccttccttccttcctctttcttttctcttccttctccttctccctctccctctcctctcctcttcccccccttgcttttctcatgtttttattggacattttcttcatttacatttcaaatgttatcccctttccgtgtttcactcccagaagccccctatcccatcctccttcccctgcttctatgagggtgttcctctacctacctacccactcccacatccccaccctcagttcctctacactcgggcatctatggagatttcatagaaccaaggacctctccacacatagatgtatggcaaggctatttattctctacaacatatgcagcaggagccatgtgtacccctttattgatgacttagtccctgggtgctcttggtagactggttggttgaagttgttcttcctgtggagttacaatccccttaaactcctgccctttttctagctcctattgaggaccctgtgcctagtctaatggctctggcaggacctctctgtcttgttttctttcatgccttgattttttttgccttcatttcccttttcttcttcttcttcttcttcttcttcttcgtcttcttcgtcttcttcgtcttcgtcttcttcgtcttcttcgtcttcgtcttcttcgtcttcttcgtcttcttcgtcttcttcttcttcttcttcttcttcttcttcttcttcttcttcttcttcttcttcttcttcttcttcttcttcttcttcttcttcttcttcttcttcttcgtcttcttcttcttcttcgtcttcttcttcgtcttcttcttcttcttcttcttcttcttcttcttcttcttcttcttcttttttttttttcaagacagggtttctctgtgtagccctggctgtcctggaactcactctgtagaccaggctggccttgaactcagaaatctgcctgcttctgcctcccaggtgccgggattaaaggggtgcgccaccacttgccttcattttctatcctattttcactgtactctgtatttgacttgtttagtactacatttctaggataatttaaattttctgtagtatttatattacttgcctttatttaataaaattatatgtccttaacttacttattttatcatatcttctttgttgttttctttttggagttccaatatttattcacttttatttatttagggaaagaatctccccagacctccactataatattagtcaattgtaagactgtcaaaggcctcacttaataggaaaacagaataatagttgaaaatacaaaggtcatctcttagtcactagttcaaggaataaatgtatattaacacaatgaatataagtttaataaaaagaaaaatattataaatggtatataacagcagggatatgatgaaagtaggggaggaggaatgaaaatagaggtaactgtagggaggtgctcaaagtttacaggtaaagctttgcagtcagatatctcttgatagtgtgaggcacaatgacccagaagaccatggccagaacatgtaatttgcacatacaattagaggaaaacaggacagaggaggaaaggaaaaaaagagaaaggaacaaaagcaaagaataaaaaagtagcatagtttaagatcagagcaaggtcaattactctggttattaaaaacaggatagatacaggagaaaaagttagatggatatatagcatacaaaacctatgatgtgaatgggtgtgctattttccatgaggcatgggaaatctagggtttactctgaaaatctttattcacccttttctaacaattatcaactgtcaataatgctccaggaattattgggctttgaagataatctatatattatccatctattgtgagactttgcctggcttgatgttttgcagataatcacggcttctttgaattaataagtgttaattttttttctctttttttcctttacttactttccccctacctcaagacaataatcacacagtactcttctacaaccttgtcacttacatctttttgtttccttctatacaatgtccataagccttggtggaggtggtaataatatactagtcctatgtggagctgagcatctagtcatttttatcctcaacatgaaaacaaattgcatatatttccattaacatctgtctactgtgaaaagaaactacccagacctaagctgatattggccttaatttgtaagcataattataactattcaaaagggaatttggcataattattatttagcaaaacagcaatagcatttgtatcctatgacttaaaatctcttttttgttgtattttgaggaggattacactgccaggacttgcttgtaattgtcatgctgctgttgaagatcaatactgtagcctacagggtctgccattgggtgggatagttgatatgttttctcccctagtagcttacagcagaacattacaacaccagtgaagataaccagcatgaacaaagtctcccagttttcagattgatttccatttggtcttaagtgtgatttgcagtagtgtcttaaaaagtagttctgtgtaactaggggaaatgtcagtcactttttgttggtttagagctctggagacattttggccaataatttatagtgatgtagcccatgacttttaatattttagttcagtaatactagcaatgaaggagaaatttttgtatttcctttgatacttatatctctgtacatcaactgaagtatgtgttatcttttaatataagttctttccatgtgattatggtgggtttaccaaagtctgtgttagattggaaacctctgggatctttctgacttaactgggacatatcctatcttgtgctgagagtaacatttagcgacccctatcttatgggaaaattgtttagccataaaaagtaattttccttgaatgcttacagattaagtagtgttttttaaatatatttttcataaatcattagtctgttaaacacacactattcccatttcttctttgaacccttgagtcctgcctgcttaactatttaagtctcagtattcctgaccacatcatttatgttactatctcttgtcatatttttgtgaagtgtatcacaagacagttggcttctatatggctttatgtgccttcttcagcctgatttttctatacttgaacatactctgattgggcctttcctccaccaggattaaacttcagaaattattgttgttactacaacatactaccccttagctcttattttttttatagattcatttatttactttatgtgagcacactgtagctgaacagatggttgtgagccttcatgtggttgctgggaattgacttttaggacctcttctagttccagtcaaccccacttgctctggtcagccctgctcactcagtccctgttctctccagcccaaatatttatttattaaaaactataaacaggccgggcgtggtggtgcacgcctttaatccccacacttgggaggcagacgcaggcagatttctgagttcaaggccagcctggtctacagagtgagttccaggacagccagggcgatacagagaaactctgtctcgaaaaacaaaacaaacaacaacaaaaataatactataaacaggtgcactgtagctctctttagatgcaccagaaaagggcatcatctcattatgggtagctgtgtgccaccatgtggttgctgggatttgatttcaggacattcagaagagcagtcagtgaacttatccgctgagccattttgccagcactactccttagctcttaacatattatctttcaaatgcctttttcctttctcagaactttaattgttccatgttaatcacacacacacacacacacacacacacacacacacacacaagaaatgagatctgaagctaggattcatgtaggggaaaactctgtttgccttacttagtcttgtttaaattcttttgatttatttaccagttacaaaatttcaattttctttagcaccgatattccatagtacaggtttaataattatctcgtcattcatctgtttatgaacatgttccactttctagttattgtggatagagcagcaatgaacagagatgtctaaatattccttatcgtagtacataaagttctttgggtatatgcccaggcgtagtataactgaatcatatggcagttgtacattttctctgtgttccccttgctgtcctggaactctctttgtagagatgaattgtcttttactcagatatctgcttgtctatactcctgagtgctgttattaaggtatttaccaccattaccctactgatagttgtatgtcttgtaaccagagtgctttggaaattgtctgggatagttcatattttataacaacagtgtgagccgggcagttgtggcgcacacctttaatcccagcacttagcaggcagagacaggtagatttctgagttcaaggccagcctgatctacagagtgagttccaggacagccagggctacacagagaaaccctgtctcagggaaaaaaacaaaacaaaacaaaacaaaacaaaacaaaacaaaacaaaaaacaaaaaaacagcagtgtgcatgagatttacacaatattggttgccctttttgtgttgtgaaatataatctttctaactatacacacacacaacctgcacccccaatattatacacatagtacatatatagataaatacatatgggtataaggccaggagtggtataactgaatcatatggcaattatttcccatcccacaggattcagttattcgtgggtgcgagggggaccacaaacctggaaggaaatgggaggaagaaaaagagaaacaggagaccaagaagatggtacctatcaaggtctcgtttattgggctgaggtgccttgtttttaaagcatacatcgcggggaataggggaggggtcaaggggaattttacaaagaagcgggcatctgctgacatgggggccaaagtcaggtgccagacagcgggcactctgcttcttatctctggaacatagatcctccttgtcagccttgggtgtcaggccgggctcaggcataactcatgtccttggatagcatgggagttcaggaagagataaggaagaggggaccataattcagcttttacagcttcaggtgctaggaagggaatagggaggagggaatgataaccatctcctagcaagaggccatttggcctgttagggagattgtgaagggctcgctttctcacggtatggtctctgacaattattaattcttttattagtttattttaaagacaaagtatctctgtgtagcccagagaaactcaatctgcagatatatcagatctcatttatatgtgtgtatacacccccctcacacacatacacatatgcacatatgcatattattcatgtatgtatacatttgtacatatatacatgtgcatgtaatatacatacatatatacatgtgcatgtaatatacatacacatatactcgcatgcctatacacacagtgtgtgtatgtgcacgcacatgtgtatgagtagtagtagtagtagtagtagtagtagtagtagaagtagaagattcttttctgagggtaataatgtcatttgaggcggggcggtggtggtgcacgcctttaatgccagcacttgggaggcagagccaggcagatttctgagttcaaagccagactggtctatagagtgagttccaggacagccagggatacagagaaaccctgtctcaaaaaaccaaataataataataataataataataataataataataataatagtaataacaataataacaataatgtcatttgatttaggaattttccagtacctgtaatttctccattcttgactctgccttaaattcaactagacagctggcttttaagaccgacttgtgagtatcctttattttatgcttactaatatcttcttgttctggtgactatcataggtgttacaagtaggtaagccattttaagtggataactgacaaaaggtaccaaaaatattattgctatggaataatgaattaccacgtgaaataatgatgttatgagagtcaatgggtattgcttagaattaaaatttaattttatcatatgaagatacaaaaggtttctttgacttcaagctgactagaatagatgctttatagaattcaaaatgaatttgataggaattgaaaatcatcacagggtaatattttatatttgtaatcccaacacttagaaggctaaatctccaaagagaacaagtacaccatggcagcttagagtgtgtctctgttgacataaacaacaaagaaaccaaaatgatatgtttccattgacattttaagaaaaattgataacgtggggctagagatgtgaaatacccgttaagagcatatgttgcttttgcacagaatgtaggttgtttttttttttttcccccagcatctatatgatagttcacagtaacttgtaacaccaatcccaggatacctttatgctgttttatgtcttctgatataagcatatacattcttgcaaggagatactcatatacataaaatagaagtaaattacaaatagcaaaacacaaagaggctggagagatgtttcagcagacaagagcatgtgctgttttctggtttccatgggcactacaatcatgtacagaagcatatagaaggacatatacatatgggcataaatttaaattttattattattctttaatcttttttacagtccagttgttatccaccacatggttcaccctccaaaacttccttattacattcctcctcccccatctccaagaggatattcccaaacattcaatcccatcagatctccccactccctgagacctcaagtctctctaggattaggttcatctctcactgaggccagaccaggcagtcctctgtattatatgtgttgggagcctcatatcagctagtgtgtgctgtttggttggtggctcattttctgagagatattggggatccaggttagttgagactgctggtcttcctatgggttttccctcatcctttagcttctttcagtctttattggattaaaccacagtgttacccaatttctgtccattggatgagtgttaaatatcagcatctgactctttctgcatcctgttggacctctcagagggctgccatgctaggctcctgtctgtaagcataccatagcatcaataatagtctcctcttaaactgcatccaaatttgggatggtcactggacctcctttccctcagtctcttcatcattttgtccctacagttcttttagacagggacaattctgggtcagagtttttgactgtgggatggcaacaccatacctgaacttgatgccaggtctttatactggagatggattttacaagtccctctccccactgttcagcattttatctaaggtccctctctttgagtcctaaacgtctctcaccacttaggtttctggtacattctaaatgctaccccacctcctacctacctaagtagcctgttttcattctttctgcttgtcctcaggaattaactccagatccctcctataatacatgatcttgttccccttttctcatctctgttccctctcacacccaggtacctccctccctctgcccccatgattgctttcttatccatccctatgtgagattgaagcatactcacttggggtctttagctcgttaacctttttgagttctgtggattttatcctgggtagtctataattttttggccaatacccatttattagtgagtacataccatgcatgtacttttgggtctgagttgctgcattcaggatgatactttctagtttcatttatttgcctgcaaaattcatgatatccacattcttaattgctgaatagtattctattgtgtaaaggaaccacactttctgtatccattcttctgttgtgtgatatctgggtaatttctagcttatggctatcccaaatatagccactatgaacatattggaacatgtgcccatgtggcatggtgatgtatcatctgggtatatgcacaagagtggtatagctgagtagatctatttccaattttctgaggaacctccatatttattttcagagtagttgtaccagtttccatccccaccatcaatggagtagtgttctttcttctccacattctcaccaacatgtgctgttactcgagtttttgagcttagccattctgattggtgtaggtgaaatcttggattcattttgattttcatttccctgatcactaagtactttgaacattttattaagtgcttctcggccatttgaaattcctctgttgtgacatctctgtttagtcctataccccgtttttaatagggttatttggttttctggagtctagttcttgagtttttgtatatattggatactagccctctatcagatgtaggatttttaagatcttttcccaatctgtagattgccattttgtcttattgacagtgttctttcttacataagtttttcagtttcacgaggtcccatttatcacacttccttcccaccccaccccacctgacctctaaactccctggggcctccagtctcttgagggttaggtgcataatctctgaatgaacacagacctggaagtcctctactgtatgtgtgttgggggcctcatatcagcctgtgtatgctgtctggtggtccagtttttgaaagatctcataggtccagattaattaagacagctggtcctcctcccttctcctcagcttctttcagtcttccctagtttaacaacaggggtcggctgcttctgtcctttgttttcgtgcaaataactgttctgactttcagccacttgttgggtctttcagagggtagatcctttttgtgatcatagtctcagtaatagtgtcagaccttgggacttccccttaagctggatcccactttggacctgtccctggaccttcttatcctcaggctcctctccatttccatccctgttatttttttcagacagaaacaattatgggtcagaggtgtgactatgggatggcaaccccatttctcacttgatgtcctcctgacttcatgctggaggtgggctctataagttccctctccctactgtcaggcatttcaccaaaggtccctcattatgagtcctgagcctttgaagttctgattgggaaatttacccctgtgccaattagtttgagtctatttcccacatactcttctattagattcagtttatctggatttatgttgaagtcctcggtaaacttggacttgagctttatgcaaggtggcaaatatggacctattttcatttttctccatattgattggacctattttcatttttctacatactggttccagtttgaccagcaccatttattgaagatgctttcttttttccccattatatatttttggattctttgtcaaagatcaagtgtccagaactgtgtgcttttatttctaggtctttaattctatttcattgaacaaattgtctgtctctataccaatatcatgcagtttttatcactattgctctatagtagaatttgaggtcaggcatggtgatttccccagaacttctttcatatttaagatttgattttgctattctgacttttttttccatatgaaattgaaaattgttctttccatgtctttgaagaattgtgttggaatcttggtggggattgtgttgaatctgtaggttgcttctggtaggatggcgatttttactgtggtaattctgccaatccatgagcattggagatctctccattttctgaggtctacagtttctttcttgagagacttcaagttcttgtcatacagaactttcacttgtttggttaaagttaccttaagatattttacattgtttatgactattatgaagagtgttctttgcttaatttctttctcaacccacttatttttttgtttgtttttgtttttgttttttttcaagacagggtatctctgtgtagcactggctgtcctggaagtcactctgtagacaaggctggcctcaaactcagaaatctgcctgcctttgcctcccaagtgctgggattaaaggcatgcaccaccactgcctggcacatttatcatttgtataaaaatgaaggctactgactcatttgagttaatattctatccagccactttatgaagttgtttatcaggtttaggtgttatctggtagaatttttgggtttgctcatgtatactatcctatcatctgcaaatagggatactttgacttctctgccaatttatatctccttgatctccttttgttgtctttttgctccagctagaactttgagtattatattgaatagatatggtgataatggacatctttgtcttgtccctgattttagtgtgattgcttcaagtatctctccacttaatttgatattgattgttggtttgctctatatttcttttattatatttaggtatcagccttgaatttctgatctctccaatactttttacattgaaggggtgttatattttgtcaaaggcctttacagcatttaatgagatgataatgtgattttttttagtttgtttatatagtgtgttacaataatagattttgtatattgaataaaccttgtatccctgggatgatgcctacttgatcatcttgaatgatgtttttttttaatgtgttcttgaattcagtttgtgaaaattttattgagtttttaaatcaatattcataagcaaaatttatctgaagttctcttttttgttggatccttgtgtggtttaggtatcaaagtaattgtatattgatagaaggaattagtgttgctttttttcctcttttgtgaagtagtttgaggagagttgatattagctctactttgaaggtctggtagaattctgcactaaagccatcaggccttgagctttttttaattgggaggtttttaatgacttctttaatttccttagggtataggtcttatttaggtagtttttctgctcttaactttggtatgttatatgtgtctagaaaaattatatatttcatcaagattttccagttgtgttgagtatatggttgtgtagtagaatctgatgttttttttttaatgtcctcagtttatgtctctttttatttctgattttgttaaattggatactatctcagggcccttcaattaggttgcctgctggtttatctatcttgttgattttctcaaagaaccagcttttggttttgttgattctttgtatcattctctttgtttctgttgggttgattttgaccctgagtttgactctttcctgccctctactcctcttgaggggtgtctgcttctttttgttttagggctttcagttgtgttgttaagttactagtgtatggtctctacaatttcattaccagggcacttagtgctataaattttcctcttacgactgctttcattgtgtcccataagtttgtgtatgctgtattaccattttctttgtgtttcaggaagcttttaatttctttcttacttccctgaccaagttaccattgagtacagacttgttcagtttccataggtatgtgagttttttgttgtttttgttgttattgaggtctagctttagtcagtgttgaactgatagaatactcgaggttatttcaatcttcttgtatctgttcaggcttgttttgtgacagattatatgatcgataatggagaagataccatgaggtgctgagaagaaggtatttttttttgttttaggtgtaatgttctgtaaatatctgctaaacccatttggttcataacttctattaattcactgtgtctttgtttagtttctgtttcaatgacttgtccaatcatgagagtggggtattaaagtctctccctattattgtatggggttcaatatgagttttgagctttagtaaagtttctattatgaatgtaggtacctttgaatttgaggcatagttgttcagagttgagactttctattgatgaacatgaagtgtcctttctcatcttgcttgataacttttgttgaaagtctagtgtagtgcatattagaatctcaactcctgcttgtttcttggcaccatttgctttgaagattttttttcaggtcttttactatcaggtagtgtctgttattgaggtgtgattcttgtttgcagcaaaatgctgggttctgtttgcatatccagtctgttagtttatgccttttattgggaaattgagtctgtttatgtaaagatagataattgttaatttctgttatttttgttgttgtagatggcagtatgtttatgtaattctctccttttagttttgctgtgagactattaatttcttgttttagcttataatacatgaattgtttcttaatcattataaagggatcatttttatcttcagattaaaagttgcttaatgccatttttttcatgttgtggaatcttgatgccagctaatttgctagttccgtttgtttctgagaatgacatttatcattgcacactgagacagtgccaggcttttaggacaagatgtgtttcttggaaatcacaactggatgaaatctgtagggatggattggtagatagatattgttttaatttatttttcccttgaatattttgttttttccatctatgctgattgagagttttgctgggtatagtagcctgtgatggcatttgggttctcttagtgtctttatgacctctgtctaggcccttctggcttttagggtctctgttaagaagccgggtataattctaatggtttgccattatatgttacttggcttttcccctttacactcttttaatattctttctctgttctgtgcatttagagttttgattattatgtgacaagatgattttcttttcttgtccaatatttttggtgttctatatgcctcttgtacatttatggccacctctttctttaggatgtggaagtttacctttatgattttgttgaagatgttttggagtcctttgagcttggaatctttgctctcttctatttctgttattctaagatttggactgttcattgcatccttgatgtcctggatgtttggggtaagagttttttctgttttgaattttctttgaccatgttgtcaatatcttctaaggtattgtctatacctcagcttctttcttctatctcttgtattctgttggcgatgcttatatatgtattttttgacctttctcctaggttttccaattccagtgccatcttcgtttgtgttttcttcattatttctacttccacttttaggtcttgcacaactttgttcaattccttcacctatttgattgtgttttcctgtatttctttaacggatttatttgtttccactttttacctgtgtttacctatatttctttcagtgagtcatttatatccaccttaaaggactctataatttacattattgggattttaggtcaacatcttggtttccaggtgtgatgctgtttccagggtttgctgtggtgggagaactggattctgatgatgccaaagtatagtggtttctgttgcttatgttcttgttcttgcctctagccatctggttttctctggtgttagctgacctgggtgtctctctggaacgtgcctcctgtgtttctgagatgctgtaggtctcctgagagacctgtgaccctgtctatagcagtcctcctatatggcttcagactgtggggtcttcagagtggcagacaagctgctgatctgttgccctgcatgtagctgatctactggtttacctttcagctgtgggatcttcgggggagcagacacgctgatgatttgttaccatttgtgcaacagatctccttggaggccttcagactgttgggtctttaggggagcagtcaagctattgccctgggtatagctgttctcctggaagaccttcaaactattgggtcgtttgacctgtgtgcagcaagactcttgggagggctttaggctgttgagtcttcaaggagcagacaagctgatgatctgcctggcagaaggtgcaggctggaagggggggtggagcttgtggtgggtttggtgggagtgatggttacctagtctgctgaggttctcggggttcctaggtgctgcagttgtttgagaatgtttgttgtgtttgttgtgtttgttgtgttctgcctgcagcagaacacctgggaggcctttagactgtggagtctttagaggagcaaacaacctggtgttcaaattcaaaacttttagatatatgtagtgatatgtgtatagacaaatctgctacatgatcagagttttgtgtgccttgatagatatatgatatttatagcttgataaaaacatcaattatacagaaagatgacccatacaagagcaaattgatactacacataatgtaaagcttaagaaaaaaatccaagtagttatacagtaaaatcatggactttcaggatagctcagagattaagagcactgactgctccttcagaagttttgagttcaatttccagcaaccctatggtggctcacaactatctgtaatgagatctgataccctcttctcatgtgtctgaagatagcaactctggactcacatatttaaaataaagatatcttttaaaaagtgaaatcagaagtgttaaacaaagtgttttgtagtaaaaaagttaattaaaatagaaaaattactagctaattcataaactaagattttgtttcttatcaaaattataattacttattttagaggatattcatatctcagactgacctttaatgaattatatagcagagaataatcttttaacttttgatctccctaaccctactttaggagtattctgggattacagtcaaatattacaacaccaggtttatttggttccagcattcaaattcagagatttccccaggctggacaactgctaaatcaactgaactactatatctctagctaaaggtaaacttttatattttagagcttgttatcatgcagattcccatatttccaatattcaggaagttgatctagaaagatcacaagagtttcaggccattttaaactatgtaaccacatgacatagtgacttccacctttaatcccaatgttcagcatgctgaggttgaaggagcactgatgatttaaggacagtctggggtatatactgagttccagattaggcttggatacagagttagactatgtatagaaatagctataatagataaataaatacataaaaacacaatttgaatatttctttagatgttgtacatgtcagtcaacaactttctggctacattttttttaattacgtattttcctcaattacatttccaatgctatcccaaaagcctcctacacccccccactcccctacccacccagtcccattttttggccctggtgttcccctgtactggggcatataaagtttgcctgtccagtgggcctctctttccagtgatggccgactaggccatcttttgatacatatgcagctagagtcaagagctccggggtactggttagttcataatgttgcacctacagggttgcagatctctttagctccttggatactttctctagctcctccattgggggccctgtgatccatccaatagctgactgtgagcatcctcttctgtatttgttaggccccagcctagtctcacaagagacagcctatatcacagtccttgcaccaaacgcttgctagtgtatgcaatggtgtcatcgtttggaggctaattgtgggatggatccctggatatggcagtctcttgatggtccatccttttgtctcagctccaaactttgtctctgtaactccttccatgggtgattgtttccaattctaagaagggacaaagtgtccaaactttggtcttcgttcttcttcagtttcatgtgttttgcaaattgtaccttatatctcactatactaagtttctgggctaatatccacttatcagtgagtacatattatttgagttcttttgtgattgtgttacctcactcaggatgatgccctccaggtctatccatttgcctaggaatttcataaattcattctttttaatagctaagtagtactccattgtgtaaatgtaccacattttttgtatccattcctctgttgaggggcatctgggttctttccaggtcctggctattataaataaggctgctatgaacatagtggagcatgtgtccttcttaccagttgggacatcttctggatatattctggctacattctgagcatagtatgtgccaactttcgttcatcttttctactttcccaaaaggttttcaatataagaaataagttcaatacgttcatgtctccctggaaatttagatacaaggaggattatgcagttccaattttgatccaagaatagtctagactgcatccagaaagcatctctcaaaaatagatgattatagtctgtcatttccatgtcagaatgtttactatgtgtagacctaatttttcaaaaaagctgccatgcatcaatacctcagttgtattacttgtatatatttgtctaatattatattaaatctaatacatttataatatttgaggataaaatatatcctatttaaatttcattaaacatactgtctatcagattgtgaaatgattacagtcttaatagaagaaaggagtgcttcacactttgattcagtttctacatgaacattatataacttttgattcattatatttgtttgttatttctatagaatgtggtttttctctgatccaggagtagtgtggcccaactctactcctatctacttaaaagacaacacaggaggcctgcacatttgaggtcaccttgacaacactgaaacctcttcttcccatctcaacaataaaaaggtgatgctatctgcatagagcccataatcttttatctgtatactcagcaaatttaaaatttttaattatcaatatatgtttaaggataaacctgttataaatgaatagaaaaaaattaggtggcagaactgaaaggaagaactgaaaggagtatagatatatgtcaaaaaatgtactgggatattacatttgctacatgtaacatgaagtatttgaagtttaaatattaattccatgtgcatggttctatacactgctagccatattaggtagtacacaggtcttgaggtgaaaatagtttgctaatacatttttatttgatgaattaatacacccttcatgtactttaaaacatgctttaatttctttttactcacctcttttaacagcaaacaccaaataaacacctgctataggaaagatcatgaaggcatatattattatatttatttgtctacattgtttatagtaattacatagcaggaagtgtaggcacatgtctttaatcccaatactcttacagcattcttggatcactgagttcaaggcaaccctgggctacagagttccaagacacccaaaacaaccagtctcaataaaataaaacaaaatatttatgcctcaactgttcaattttttctttataaacgtacactgtggccaatatattgatcaactatattttagtaaaagtaattttgttattataggatagcatgtcatgagtttgatacttgaaataaaaacactttcttacccttagggatttacgcttttcagttgctgtgaataaactaccatgaccagtggaacttataatggcaataatttactgaggatttacagttcagagggttagtgcatgattattctggaatgaaacttggcagcaagcaggcaggcatggtactagagcagtagctgagatttgatatctgaatgcactagcaaaaatgcagagaggtatctcagaatgactaagagttttgaaacatagaagcctaccaccagtgacacaccttctccaaaaaggcatacatcccaatattttctaaacagttccaccaactgagcatgtaatggataaagttataattaactttaaattactctgcttgataaatctataaaatgtttctaacaagtaaagccccacttattcaaggacagataaattcttggaatgcttaaggctgttgtttatgcatgataacaagccatatgcttttttggttctataaacagtattggttttcccaactatacagcatatacttgatcacatgtaggcaggaggtagtgaggcagaaagtacatctagatgtatgctttcccctaattggacaaaggcaggaattgtacagtcttttgtgggttttacctttaaaattcctccataatgtatttttctgtgatatgctggccagtatttaataaagattgcttcagatttagctcaaaaattgtggtaaagctcttattcttgcccagtggaattatcacgaatcaagaattcaaatatgtgaacttacagacaccattcttgcttaaactcctgcattctctggcccacaaaagcttctggttatatgaaaattcaaaatttactcctacttcaaatcacttcatagactttgacagtgttaacacattaaaagtccaaagtttcatatgaaaatcaaggcattcttttaattataaagcttataaaattcaaaaagtatgttatatgcttccaatacacagttccagaaattgtttattatctttacagaagtagagaaatgaaagcatagtaagaaaatactggatcagagtaagagtgaaacccagcaaagtacatttcctataattccatgtcttataccacagtgcttacatgcctttctcttccaagttttgttgaataaagcatacttctttctcttggtctagtttcactccatgcctgcagccctgcttgacagacagcccatgactgttctggcacctttaatatcctgtggtctcactttcacagtttcacgccatggcctctcagaactgcagggactacagtaccttgagcctggcatcagttgctttccataacaaagaaggaagactctgaccaatttattcctgtattctccatgattctaaagccacaaccatatcttctacaaaacctacttcagctacttgcttgatataaagtctgacccattctttgaattatatttgcacacatttttatttgtttttgcttcctaggaatggaaaatttcttggcctttttctttcacaagttgcaggattagcttggtagaccctgggggtatcacaccctttattccattcctccatgactctccttaccttttcagtacaagccttagttccaatattaaatttttggtgttctttttctcttcacactatgtttttattttaattttttgtcttgcttgttttttctcattatagacctgtactagagtaatcactaataaccaagtgacagaacccatgctaggctgtcctgaaaactcttctagcaaagaaattaatctaattttgttttaatttagccacaggaagattcttttttttaaggtattttcttcatttacatttccaatgctatcccaaaagtcccccatgcccttccccccacccctctacccaccactcccacttcttggcccacaggaagattcttatgagaaagggaaaataaccaaattgattgccaaaataacatgagatggtatctagcctagttgctaatattgtttccactgtgtaagcttttgataaggctccatagctcacattgccttcagcactactatcttccaaatttctgctagaatggcttgttaaaccctgcttacagcatccaactgctttccaagtccaaagtcttaaatttttacatatactttcaaaacacagtgtgctaaggactatcatagcaatactttactcttggtaccaacttctgttttagttgcattttaatttctgtgacaaaacaccatgagtaaacctactttaaaataaaccattcattagggtcttagatggtgagaagcatggcagttggcagaagatattattcttcaaatcactgcaaaggttgtgcaagaagcttttaggacttcagatacaatagatatttattttctctctcttttttttcttccaatagagggagttcactataggttgcaagcaataagtaatctttctgctgttgactccctgatgttaggatttggatttttaaaaaaatatttccataataaattattgaatatagtacatattttaatctattagttgataggatatagaatctaaggatcctatattgaaaatactaggttaaaaaattaaagtgattaaatagcatataaaatatgtaaaataagaaataaatgaggaaaattatagcagtcatttttttatattatttgtcattgccttcagaactagatgctgcttcagtgaaattcttgtaaaatcttgaggatatttatttattggaaaactggtaacgttacttttttcacttaaagtctacttctatgtactctcctaggtggtgaatatcttcagatacacatcaaatatgcctttctgaaggtttcatctacagcatctcccaaataccattatatatttattgtttctggagtattattttacctttattatctcacaacttctatagaagatttccaaggaatagaaatgacctgctcttggcaagtaattgcccaaaatgttcaatacttctgttttgagtatatcttgaactctcatattgtttgttgcttattatcttttattcatattttaatttgcaaatgggagaaacttttctaagtgggttgcatagctaatgtatataaacatttttatgatacttcagattatagcaacattttctgactaattgaatctccctctatatcagttttgttatcgtttgtgagatatcttcttcctcctttgaataagaaactcagattttaggcaggccctaaagaagattgtttggtacagtggtgttctttagagaagatgctctggtgctatttttgctgatattatggtctctgtctagtggagcaatatgagtctctatggtttgctttttctccaatatgactactggagactttgatgcccttgtaactgagtgggttgagaaatgttgtccttgcactgataaggagagacatagtgatgctatattgtagaatgtgtggcatcatatttttttgatatcacttttcaggtgtgagtgaaatctcaatgtttcaaagtgatttttagttttctgtgtaatgtgggttttttatgttaatctccttaaactaagtaatgtgaagtagtgattattttcaatattagttgtgtgtttctagataagtcaccagttcatttgaaaacgactgcctttctcaactggttttaataattgtaagagtgaaaataattggtaagaattttaaagtgtctggatatatatgtctgtatgtgtgtatgtttgtgtcaggtgtctgtagaagtcagaaatgaaattcaggattatatactaattttattttgaatgcttgaattgtttccttacacattacttaataggtgtcagtaagaaggctcaatggaaaaagccaactgggaactccagttggatcactggaacccaggttatgtgtaagacagaatatagctgacaacagaacacttcacagattatttttaatctcataaatttgtagtacaatccatatcgccttactcattatattattattacattttagtgatatcctgaggtgcatcctggattctttttataatgctcatttattttgtatgcagtgttgtttttcttgttttaattgcaagattaaattagtgtatttcaattagtctttcatatttacattttctggggtcagattgcttatgattaatcagacaccactacaacttgtcagtttgtgttaagggccacaaaactttttaaaaacactagatttacagaccatatttttgaaactaggaatctgttcttgtagtacaagaacaattaaggctaatcattaaaccatgcccccagaaatagttgcaatacacaaatcttgggttatatttgtattttagcagatagttgtctaacctgtagtcagttgtgtaggtctagtttcatccagacaatctttggtagatttaggattagaaggtacagaaagagtatcttttcttgtacaagtttctgaatgctctacatgagtgattctcaacctatgggtcccaacccctttgtgggtcaaatacacctttgactaggatcacttaagaccattggaaagcacagatattttacattacaattcataacaatagaaaagcatagttatgaagtagcatcaaaaataatttgatggcaggaggtccctattatatgaagagatgtattaaaggactgtcatattaactattttaaaattagatgttttagttcattataatatcaacatctattgtgatcaaataattctgtggtcattaattgctaatctgctattccagttccatagcagcttatgataagggataaactttcatggtatatatacttgtcagtaactttcttatgtttatataaatgtacatggagattttagatggaagatctttgtattaatgatttttccatttaatctatcatcgtggtttatggagtttacaaaaatatgtttgctgctgcttgtgatgctgttgatgatgtgtataattatttaactatgataatatttttgagttcctgcttatataatagttttccaagtatggtaatattaaatcatcatctgtatatgtctttggtttctgtcaatattgtgaagttacctgcatatgttttctgggttaagccagagcagtggtgtaatatagtgctaattttcatagttttgtttatactaagtttcaatggctttgtacataacagccaatctaataggtgaaataatattttaaagcctaaattaagactaattttaaatgcttaatggccatgattttataaaactaaatagattttcagttgtagaagcaacgtaaagtttccaaattttgctaagtttacctagtgatacagcaaaggttgcatagtgataccttgtctcaatgtttgcattttttcataaattgcttaagtatacactatggtaacaagcttttctttatatttaattttgatgtaattatagaaccacatgcttttttatataatctgacttatgctctgcattcatttcacttattattcccattactctttccctctctagtcttctcatcttatttctgtttatacatgtcacagaactttgttttcatttaagatatgcagttcacactggccaaaatttttctgtggttattttataaccacataagtgtgcttatgttcctttaatcttggcttaaaatataagaaatgttgattgtcttgttgaactataatattaactatattataatatattataatgtaatatgttataatatattatagtattttggtaaggattatatgatattatatagttatcctctagattcccatttcttttctaataaaagaaagaaagaaaggggtggttacatttaagaaaaggagtggtgatgaaacataattagagggaggagaaatataattatcatatattttgtgagaaaatatctataaaagaaagcagaataaaatttaagaatatcagatgcactatgactagtttaaaagtatgtcatatgcattgctcatatttacatttcattagttggtttagtcgtgttttattctgtgggataaaacagaatttgcaaaagccatgtcgctttcatattacttaatttgaatcaaccctgtagactattttggttattcatagcattgaatttcttggaaataacaccttttagatttcaagagccctcagcttctgggtttttccttgtaaaaggatggcggacatatatttgtcatagaaaaacttcagaataaatgtgtgttatcttcaataaatcatgtcaagtctaaatgcttattgtcccaaaatggatgatcattagtttaattcaatgtgtcaactttctccaatgttgaagttctttctaaataaacattacatacaatgaccatttgaaaatatagatttctttttaatcaaactttaaccctatcaatttaaatgttccttgtgtttctatttttgaatactataagcaaatttgacagcacattttcagtgagcatctggtagaactcttgtatgaataaatctgagccagggctttttaaactttttgtttatttatttttatgtaatacattttgataacagttttccctcttctaaatcctcccatatctcttattatcagaaggctttattctactgtttctttaatagagtatttccagtttgttaagaagataactcttggttcaactttggtagattggaaaaattataaattcacccagttcttttagatctagattttaagttctgacataatggaacatatatttttaaagtgttcccttatattattatttttgactttttaaatgtttgttttgtttccttgatcatatctgattctagttatttaggccatcactttcttctttttgttaattgtgtccattaaatttgttcatcatttcaaaaattcagcttaatgattcattgacccattatatttttttcatgtttcattaatttctgctttatttttatactgtaaaattaaatatgtgtattttttaaatattatttttgcttttatttttcttacagtccattgtgacttattcatattttttcaggttcttgaactatatcacctagtcatttgtctgtgctatttttaggttgttttgtttttgtttttgttttgagatacgaccttaccatgttgctaggtgttacaaggttcttcaaaactgagttaacagccagacaggttagcacatacctgttatcttaatgtgtagaggcaaagaaaggaattccatgagattcatatataactgggatgtctagccatactatttattaaaaaataataaaaaccaaaacattaaaacctgggaaaatttgacatcacttactcattgctatattggataagattggtttattgattttgtgtgtgggtgtttgtgtgtgtatgtgtcagagagaaacaaacagagagagacagagagagagagaggaaaagagattttgagagactgctattatattaatcccttaacaaaaacttttaaagtaagaatttagctcctgatagtttagagagagaaataatagtttgtattaatcagtgtatgatttacttgtgatcataagcatatacaagatctagtgacagttgatataagaagaggaaaagctgcttgaagcactaccatggatactttagcatgaaggagttgagaaatcagtcattcctttgtatatcttcctcatgtcagtttccccttttattgttttgtctgcattgtagaatgtgaaagctcagtccttgattttccatatctactcattgaaaacaggaaaatctggtatatgtgaatattaaggtatattaagaataaatttcaaaggtaatgggatagtaattagatttttgtatggcaatgaaagacatagtttacaaatatagcttacatcactgttttatgtaaaagtgttgtgtagagaagggagaaaatggtcaagtttaaatctgagtatacctttgaatagatatattatcctttgatgatgtcatctgtatcatcatagcccagaaatatgctcacatattgcaaggttcttttaaaaagttacttagattttccatatagaacctttaggatctgggtggtggtggtcgtggcacatgtctttaatctgaacgctcgggagacaaaggcaggcagttgtttttttgttttgttttgttttgttttgttttgttttgttttgttttaagttcaaggccaacctagtctacagaatgacttcccatccatctgggattacatagagaaaccaggtctcacaaaaccaaaacaaccagcaaaacaataaaaaaaagaattaaacaactttgatagtgtttttcctcccattacttctcccagatagttcctacccttatctgccaaatgttatcacattcatctctgagtggatacaaaaatattagaatattacatgtgtactatttgacattttctttggcattccatgttggttgcataaatacattactgagtatatttaacatcacagcattataataataatcttttaatattctaaaactaatctaatatcattttattcccatttgcagtttcttttacttcttgcatgcattgaataatatttttgaggcatagtttttgcactgcttaaaaatatgtgttttttgaaaaatttaagatttattgagtaatagaatgaatgaaaggccaagcaaaatgaaaactaccaattttaataagtgaataaaggagtcaagatatatgatgctagaaatcaaggaagtagtgcagtatagaatgtacataaggaagaatttgatagaagtcctagtagggcaaggtgaattttgttcacattagtttatgatattattgctgaccgacagtaataagtagagttaggagaaagtacgtgtatggaagatattattgtcaagtgagccaagagaattgtgaaccttatttccaggaatgtattataaattattttctacttagtggcttataaatgagcacctatttttcaaagagtatcaatatttataccacataatatatgatttatatctcaaaaatttctttttcattcatttatctttcatttatttactttttttagaagactaaaaattttgagctcttaattacaaattaatagtcatttaactctggaaatataaatcacatattctgcttattatcctcttttatatttgctatttggtccctaccaaaggagtcgttctagccctatttatactcttgtattttaaatattttcttttgggagctattgtagaaaggctagaaatgaatcattggtaagacaatgcaggacgcaatgtcaccaagaatactgttttttaaatctttagagcaaacactgtagtttaacttctatgtctaacttcaggtactttattcatgtgtcacttggtcctatctttttattgcaattcttgacctaaactgttttaaaatttttagttgagttttaattatgattatttgtatctatgtgtgggtatgtgtgtgaaaatacatgtgcttctggagaccagaagagggtatcagggcacctgaatctggaatacagttagtacagggaagctgtgagctggccaacaatggtgctgggaacttatgtcatgtgctctataaaagaaatgctctaatctactaacacacatccctaaccctgacataagtttttaagcttatttgtcaaggtctctcacattccatggtaggcatttccttaaagtactttattttcatttcactttctgagcaagttcatgtgtttagtattgaaattcaaccagtactacacatctactgatgtatgacagatgagaatatacttagtaggttatcatgacacatgcttttaattccagcactgcagagccaggcatatctctatgagtttgagtccaatcaaatcaacataatgagtttctgtctatctcaaaacaacaaaacaaaacaaaacaaaacaaaacaaaacaaaacaaaacaaaacaaaacaaaatactccccccaaacagcaactagtgtgttataagttagataccatttgtcttagtttggattttgttgctatgacgagacactatgaacaaggcaactcttataaaaatacagtggggctggcttagcatttcagaggtttagttctttgtcattatggtttgaagcatagctgcatgcagctaaatatgctgaaggagtcaagagttctacatcttgatctgaaggtagcaggagattgtgtgctacactggatgtagcttgagcattggagactttacaggctgccgcacagttacacactttccagcagtgccacacccactccaacaaggccatacattgttggccaccctctatggcccaatcattcaaacatgaatctatggtggccacaattgttcaaatgaacataccatatgacaaagaaaaaaaagggttgtttgttcaaaagagaagggatattcttctttttggaaagttttaaagagtctagaaacagcaagatgccacacaagcagtatctaacaaatctggtactattatatgcattgagtttattgctgtcttatgaactattctaagtaaaattaacattttactaatattacatttgtaaaacttgattcttttagttcaattttgaatagtaccagatttactaaaacatttcacattcatttatgattatcttcattgataatattttgtgggatcccacacatgtccttcttatatctagtgttgaaattttttttataaacatactttttttaaagatttatttatttattatatgtaagtacactgtagttgtcttcagacactccagaagagggcgtcagatcttgttacagatggttatgagccaccatgtggttgttgggaatttgaactcaggacctttggaagagcagtcagtgctcttaactgctaagccatctcaccagcccctgaaatttttgtttggggatattttgctggttttgtatatttgggtgtgatttattgaacaacagtgagatataaaatacaggaaagatcaagatgccttaaataattgtaggtatttagtcatttcttcatttttactccgtacttcaagtttttaaacattcatgtttacatgtagtattttgtcccctttcttcaaaagaaattcagtgagctcctacttgacaggaatcattttctttctattatcttacagtgtcgtttccaaaggagagattttgcttaaagtttacaaaataaaatgataaaggaaggagtgaaaaaaaaactttgtgaattatactataatacatttgtaaaaagcaaaattatgttttgttagaaatgctattatgaaaaatgtaattatagtcatttagtagtatgcatgtttgataggatttcgaggaacttgtaaatcatagtggtttttttttcctcttcagttttatttctgtatttgttcagtgaattggtgtctaattcttacttgtttacaactacatctttcccaacccttctaagtcgtagtagagaattttgagagttgatcacagaagacactttaggtttttctccagatttatgaggttgtcagggaaaaatttctgggaattttgtgaaacaatgaaagtgaaggggtattcttgctgcttccattgatgcttaaaataattgtgagacacctgaatgactagttttagaacttagatcttagtaaaaatttaatgtttctgatatttctcaatttgtaaatatacttaaatactaattcattgtttactgaaagacagcgtccattatgatatttcaggtgatataattcatccttattctctcatacccactctgcctttcccttatgtatcatacactggccttgtagcccacatttaaattgttgtcttccctcccaactgctgagattccaaatgtatgccagtatgcttgactttaagatttttgggtataattatgtttaattatatttaatattttttctgtaagattgtctaggtcacactatgtagacctgtctggcatcagattctctctgtagaccaagttgattatcagactcagaaatgtgtctgcctctgcttccaaatactagccttgcaagcaggtaccaccaatcagctttcatttatcctaatatgcccctgtaaaattcactattgaaacataagattatggttaaattttctatagctttctttaaaggtaattgctgcttatagaattttgttaacactgattgaaagtctgagaacatttgaatatttgttcttcataacattttcctccaatttaagacattcatagctagttatttattgcaaaatacttgttcacgtcatgttccttcatgtgattttcttctcattttttggatgatgaatttcagtatagtttaggatgagcatgaatctttggaatgtagtccctgcttatgtggcttttgtgaaatactataggtaaaatgtaataatttctttgtttgagtagttggcttagcacttagtagtaagtgaagttttacatgttaaaacagagtatgaggttttagcaaagtaaatgagttactatttaattacaaaaatccatgaactagtttctgtgattgtttctttttaaaaatatttttattaggtattttcctcatttacatttccaatgctatcccaaaagtcccccataccctcccccccactcccttacccacccacacccacttttggccctggcattcccctgtactggggcatataaagcttgcaagtccaatgggcctctctttccaatgatggccgactaggtcactgtgattgtttcttatttcctttatgattttagagaaatgagctccattgacagggaattagttttatagagacttattttgagaacttattacatgacaacctttttctccttctttctttctttctttctttctttctttctttctttctttctttctttctttctttctttcttctctctctctctctctttccctccctccctccttccctctcttcctcccttcccttccctccctccctccctccctccctccctccctccctccttccctccttccttccttccttccttccttccttccttccttccttccttcctccctctctttcaccccaaatctgtagttctccccacaacccaccccgacaaatctcttgacccattaccttgcccttcttctcatagaaggggaagtctgtttttttccccaccttggatatgaagtcaaaacagagacagggcaatccacccacttgagttgttggggtacccacttgaagtccaagcggcatgtctgcagcatgtgtgtgtgtgcggggaggcagaggaataaattcagcctctttggttggtggttcagtctctgaatgttccatgttagttaactctgttggtcaattttgtggattctctactcactctgggttcctcaatcctcacaactcttccacaagactttgtgaaccccacctaatctttagctgtgggtctctgcattgtttctgttagcttctgggggagactctgatagtacagttttgctaggctcctctcgataagcataacagtatcatttatagtgttagggatttttttcttgcctatgtgatatagctcaagttgtgccagttattggttggccaccacatttgctctttgaagttcctaattgaatgggcattatctttttttatatttttctattcatcacatttatatgtaagtcttgtttcttagcaatattgtttttatatgtatcacttgaacaatgattaacacacgttgtaacaaaatgactactgaaaagggtaatatttagcctattaaatttagactaaacaatatatgcaaccaatgtgtcatattcattctaattatattctattttagacatttccttatttctatgttgtgtggctctaaaggttaatgctagagtattctagaattattaatttaagattaacttgtaaataagtcttatttttccatcaattatgtattcaaaatatacttagcatattttgtgaaaggttcatttaaatcaaccggaaaagtaagaatgataggaaaatgtgagaaagtacatacatgaatgattcaaaaatgtgttataaatggccacaaatataaaaatatattcaattatgtacatttttttactaaaggattaactgtcatataaaataagatcagaattataaaagatatattaagaaatgaattttcttttttcacctatgagattcgatgaaatatttgcaaacaaaatttaaagcaatttaaattccagataatattgaaaaactaattaagatagagatatatgatgaaaattagcatattttatcactatttcacttttagaaaatcacttatagtatgtaatttgaagtttaaaatatgtgaagcattaagagtactcatcatagtgaataattatgtttgttattattgatatatatgtatcaatcataattttaattaagtaattgatttatgtctagtgattatgataatgtatgttcaaattagctggcaaaggtcccagattgaaaagttcattcatttttgctgagaaccatttatgtctgaaacattgatgtatatatccatatcaaatgttatatgcatatgcttctctatgtggtaaataaaccaattttatcaaatggatattttaaattattcataatgatttcttgtcattattttcctcatatttatatttttgtgttgtaattttcttcgcataaaaagaagatggagcacaaatgctcagtagataaagctacttgttaccaagactgacaaactaagttttacttacactcccacccaccccacccaccccaacatactcacaaatagaataacattttaaaaatgaagtagggacatcactatttgactctattgcttctttcctcttttttttttttgtatttcacattcttcctccacttgtattatttttttttatattaagtctcttattatggagttctgaaatatttgaagacttaattgaacagatgtaaataccataaacatatcctgcaatgtgtttttgtccaattgtaactcattatcttatgttcagattttacataagctaatcaatgaaatatatgttctatgatgatagaacatatcatcttcacctttcatttcttattcacttgaaccctttttcatttttaagttaaaacttaactgtaaagaacttgctgataacttacttctatagtccttaaggaccttttcctcatgaaatctgtaactccacttaatattgtatattttacatatattttctacaaattttctgatttaatttttcttaaaacctgaatagttatattatgaaccttaacagatttaccaaatgttcattgttgcttcattcactagttttgctccacttctttggtcaaataccattttctatgatagcgtgtggcattctctaggtatatacctaggagataaatagctgggacaaatgttagctacatctttaattctcttttgtggaaggttaaaagtagacccttgaatgtaggacagtttacaaaagaaacatgaatggtcaataactattttaaaagtatgcaatatccatacccatcaggggaatgcaaactagaagtaccttgggacactagagtacatcagtacaaattgatgtcatgaagcaatatgaaaggatatggagaagaatgttatacactgaagatagtattgcaaattaataccgttatggaaattagttattttccaacacttccaactagactttttttttaattaggtattttcttaatttacatttccaatactatcacaaaagtacccccataccttcccctccactcccctcctcccccactcccaattcttggccctggtgttcccctgtactggtgggcctctctttccaatgatggcctactaggccatcttctgatacctatgcagctagaaacacgagctctgtggggtgggggtactggttagttcatattgttgttccacctatagggttgcagacccctttagctccttgggtactttctctagctcctccattgggggccctgtgatccttccaatagctgactgtgagcatctacttctgtgtttgctaggccctggcatagccttacaagagacagctatatctgggtcctttcagcaaaaccttgctagtgtgtgtaatggtgtcagcatttggaggtaaaatgtggacacttttccctttcttagaattgggaacaaaacacccatagaaggagttacagagacaaagtttggagctgagacgaaaggatggaccatctagagactgccatacccggggatccaactatactttttgtcttatatgtacagccacggtggaattcactctggaattttatagtcactgaagaactatcattgctttgtacatacttcatgaatgcacacagctgccccttgtgaagggatcctctttagatagatctctggaaaagttacagatttctgtttctgtcattgtagtctttgtatcctgttgtgcgtctttcatggcattgtcagccccaaaacctgagtaggcagaacattgacagtcatatagtagctctgaaggtaaaggcctggcttacagagccctttgattgtactgaggacctatcaggcagactattagcaggaaaatactccttctctatatttttagttccatttccaataccttcctaacttctctttccctaggtttatattggaagaactgagtattaatatgatttaccctgaaaaatagaggcagtgtaggtggaaacacgcagtcctcagtgacttggtcagtggaggaagtgcttcttgtcaaacaaggtgtagttgaagatatcccagagatatcatcacatgaatattaaaacaccatgttcaatttagtggtccagaaggggcattgtctgtgccaaaatgtattgagaagttgaagactcagaagtctacaggtgtggggagacaccatagacaagaaaacttttatgaagttaatggattgcagtcttctcagatggatgaattgtgcattgattacaaaaatggaaaggagacaggcaaacatatcgacagacaaagatagagacagagagacacagagagagacaaagagacagcagggagatagaaacatttctagtgtctcataaacctagatggtatgaagaatattgatagggaggtagaagtgctactagtgtatcaggctgaccattctctataaaacaaggtagaaaaatgttcacccatttggagataatgacgacatggaggaatactatttgaaggtgatgttttggatattttcattatgggaaatgcctagcttcagggctagcactggtcagtgaaacccaataaacttgtccttggaaattccattaatgaatgaatattgaataggagagacattgtcagacgatgatcactgatgaaaatttaatactcatttgtgttggttggaagtatttgatgtattagaagccttaggattttgtcagtgactactgtcaaaaaagataaaagacatttcttctggctagacagagagaccactggagagcaagaccttgagactaaaccacttccatctgcagagacccttgggaaaaatactgacattgcagtctgataaaatggtgtagagagatcatgggaaggaaaggaataggtttacctggtgttcccagtcagactggagtggtgcaatgccacaatgtatccctctgtagagattgtatatgcttatattttcacctcaaaattttactcccatgagtcataccttcagtccaataagaggaagaaccaatcatttatgaatggagaaaggcacctaatagtgtctcatgaaatatggtccaaggtgcaggtaccacagaagaaagtagaggatactggtaagcattattttaatttctcaaagtcttcatgactcttaaggtttttctagaagtattatgacctaaaattgcacaaacttgtgaaatcctaccatctctcacatttaaagtttctgacagttactactttggaaaagtggaaggtcttaattttcaacatacttatcatatttctgcaattttaagagtataccgaccacctgattgcaagcacccaacaattgctacttggccaaaatggtattttccagtcaaacatttatttgtaagtgcctaaccaaataagtgattactcattatcaccattataatcatgactaaaatgcagcacattcactcatctaagtactgtacaagtcatacatatatttctaagtcattgcactgcccttgctgaccaccagatttggcaaagtcaccttacagaagggcccaagtttttacatttcttgataaacagacatgtttgtagtgagcataatttgggtacttaggaatctccctgtggtaatgtttctatgtaggcaaaagtggcaagaaataagataacatagtcacagacacaaacagcagatgcatagttacctaccatctaaaaatacatattttctgtgtggagattttaccaggcttgagtttgttagttaccatgaagtagtgtgtcaaagaaatgcattgaaataagactctgtcttagaatttgcttcattggggatattattagtgtaatccatattcatgtgctacatctgccttggtaataaataggaaaagtgtgggtccctgaatgtcagaacatgatttgcaatccacagttgaaaagagagcaagagaccatgtctgaagctgttaaaggctggaggtactctgctgtgggacatggaatctttggcccgttgtgttgagtgattttttatcagatggccaaaacagtcctgtgatgaaataggctgtttgtgttgttgacaagctgaaaatagttaggtggacctgcttagaaagagagcaagggacacatgtgttagtcatggaaggcatccatatccatgtttgtttccctgacttacacccatacatgtgcacctagaatttagtcttgaatttcagagtaaacaggtaaaaatattaagatctgtgaatgtctgtatgatataagtgtatcaagctgtatagaaataatatcgaccatataaataatatagataatatatcgacttaacatagtcacgatagttccctggaaatgtttgggtcaccaaagtggcttccactaggaatctagcaaaacaaagatatgagagtgatgggtatgggctttctattaaattgtgacagtacatgtcttgaacaagccttaaaaatgttgatggttgccacagtgaggctacctaataatgtggacctcagaatagtgacatgtctatgttttcatatttataggccttgtacatatttctgttttgttctgagcctttttatcatggagagtacatgagggttgccagagttgacagagaatgtcaacaatagctgctgagttccagctatttggaatttatcactccttttgcatatttaaaacttgaaggcaagatttgggccaaagaatgggactgatctgtattttctatcacacccacagtgtgccaggggggtctcttttgggtctgaatgaactttataagaaaaatggcaacatattgtattatgaactgaagttttggtgatatgtctcagaagggttgtttggtctccagtttggtggccaattgaaaaattacctagtgaaacatattggtagatagatacagagaaagacagaaagaggccaatataaacaaatacaaagagagtggagtttggttcatattgccttagaaagtatgtcacttactgctggaaaactggaaggacaataggataaaaatttggaaacactggtctaaagcttctcagcatgtattaggaatgaagacttcgtaggagtgcctgtggtctttctacacatataggtaagtgtttggagttacttgatgtcttctatgtcctgggattagttttgttactgcagatatgtacagaggtcatcctgaaggcaaggaagggagacagggtaacaccagtttgcatttggccctttataattgaggtatgtgctttgatctgtcttctcaaggtcacattctgtggtgcccatagacacagtgaagagatacatggtcaacatctttggatgagggatgagaatattagaataagactccagaaaagttgcttggtatgtctgtcttacctgaggaccaatggagtttaaaggtaagatgtatttgaatttctccaattgctaatgattctagcatttttgctgaaactgcaaggatgtaccataactttatccactcctgtcaggacctacagcacttttagtgactttgaaagctttttttcattttctgtcagttttagtaactatgaaagtcccttgatgatgaaagttttggaattttcatactcagtgatgtatacactctgcatagtaccttgaaaagctttgtgaaggggtactatagtgtgtcttgatcaatgatgattctcaaagattctctggaaagctgaacaaaatgattgattacttaatagcaccactctcttctggactgagatttatcacattgaatcacccacatcccctggagtcatataggcttataatcctctatactttgtgtcctcttttatttatatcagataccttgatgagagaccaatctttttaggactctgctatcatgtgtagtattcatgaaaacaacccatatagggtttgctggtaacatccccatgctcttggtgaggtacattctcaagaaagaaatggtagtgttggtagcttctaggagtggcctgcaggcagagatcagatctgaatcataaataggagtagcagtgcccccaaagcttgaatctacactcaggggattctaggccttgtgtgtagtcttcttagaaaccttgaagtttattggagccctgcagtgctgcttcagagaaagacactctaatcaaggatacaggagtaatttgcactggtgctaaattcttaaagcctgagtgagtgtgtatgagtgtgtgtgtgtgtgtgtgtttgtgtgtgtgtatgtgtgtgtgagtaagagagagacagagagagacagagagatagagagacagagagacagagagacagagacagagagggagggaggaagagagagagagggagaaagagagagagagagtgagagagagagagagagagagagagagagagagagagagagagagagagagagagagtttaatgttggtaagttcctttgtagctgagtaggcagactgtggtgctgaccaccaggatgtttttccatgcaccctgcttgggaagagagcaagagtaattctgtgtgttcctaaggtatgtttggttgctatgtataggttcattagaagatgggccaaatgacacacaagctgccacagattcaagactaggcttgaacattaccacatggtcattgacatctttaagaagatcctgtccttgaatttggctcttgtggcaataagaaatgttgagtgtttcagcatctttttgaagtttcttgacttctagtgatcattcaaacaggtttgaccaattttttcaatgtcagagagagtattagtgtgtgtgtgtgtgtgctcgtgtgtgtgtgtgtgtgtgtgtgtgtgtgtaagagagagacagagacagagacagaaatacatagagacagagagacagagagacagagacagacaaagaaacagaggcaaagagagacacacagagaaagacagatagaggaagtgacagagacagagcagaatgacaggaacagaaagagagcagattgttgttgacaaattgatctagacaatcttctcattactgttgggtgaaatgtaagagtaagctgttgagcaggttaaccatttccctttactaggacagagtttttaacacaacaatagcaaatcagaagtcagaagcccaagtaatgtgaagagctgttcatgaaggtatggttttactggtgaacatggccagtgttgatttctagctcctagctggtagatattgagaagagatctcccttaatagtgtactaagttgtcagtgttttctgggaggacttttttttcttgtatctttaattttttgtattctcttatatattacatcctgtccgcagtttcctctcaccctgtgccccaaactcccccttttccacccttctccacaaaatccccctctgctgcccttagataatactagacttctgtcttagtcagagtttcaattcctgcacaaacatcatgaccaagaaacaagttggggaggaaagggtttattcggcttaaacttccatactgctgttcatcaccaaggaagtcaagactggaactcaagcaggtcgagaagaaggagctgatggagaggccatggagggatgttccttactggcttgcttcccctggcttgctcagcctgctctcttatagaacccaagactaccatcccagagatggtcctacctacaaggggcctttcccctttgatcactaattgagaaaataccttacagttggatctaaatgcctccaggcatttcctcaactgaagttcctttgtctgtgataactccagctgtgccaagttgacacaaaactagccagtacagctttcctggggtatcaaccaaatgtgatttaagaagctataataagaccaggtacataccaatacatcaatgctagaaaggcaacccagtaaaggggaaagggtcctacaaggagggaaatgtgtcagggacagctcctgctctcatgatttgtgtttccacaagactacccatggcatacattagaggacctaggtgagatagcttcaagttcctgtcctttaagatcccataagtcctggtccattgattctatggggtgtaatctcttagtctatcccctgatcctcctaatttttcaaatccttatcagtgggactccgcaagatctgcctaatgtttggttgtggtacactccaatcagttgctgcatgaaatctctctggtctccttgatcctttttctactatgcactggtctcatcatattcttgaggaaggacaaaccagaggctgaatcttttgtgaccatgttgatgtctcagtcacccacatttaggtcttacctttttaagaagaggccagatcaggccttgtgtctctcattactaggagtctatgctaaggttatggtaatagatttcacagaatttccattgcactacatttccatattgaaatgcccccagtttagtttttttctagtattttctcatgccctcgcccctaccataattcctcttcctagtctcacccatacagaatcgacctggaaaattttttatttcaccttttcatgaagattctttttttaaaaaatatttttattaggtattttcctcatttacatttccaatgctatcccaaaagttcccccataccctctccactactcccctacccacccactcccacttattggccctggcgttcccctgtactggggcatataaagtttgcaactccaatgggcctctctttccattgatggccgactcggccatcttttgatacatatacagctagaatcaagagctccagggtactggttagttcataatgttgttccacctatagggttgcagatccctttatctccttgggtattttctctagctcctacattgggggccctgtgatccatccaatagctgactgtgagcatccacttctgtgtttgctaggccccagcatagtctcacaagggactattttgttcatttccatcacctgtttggttgtgttttcctgcaattctttaagcgatttttgtgcttcctctttaaggtcttctacctgtttagcagtgttctcctgtatttctttgagtgagttattaaagtccttcttgatgtcctctaccatcatcatgagatatgcttttaaatcccagtctagcttttcgggtgtgttggggtgccctggactggttgaggtgggagttttgggttctgatgatggtgagtggtcttggtttctattagtaagattcttatgtttacctttcgccatctggtaatctctggagttagttgatttcgttgtctctgattacagattgttcctttcatgattttgttagcctctatcagcaatcctgggagactagctctctcctctgagtttcagtggtcagagcactctctgcaggcaagctctcctcttacaaggaagatgcacagatatctggctgttggacctccctcctggctgaagatgaaggcccaaaacaggacctgtaccagaagctgtgttgctttggcctgtcccagaagctgttagcttctgtagtccatactctcacctgtgcagactactctctgcggagtcctggaaccaagatgtctgctgccaatgctcagccaaagccctcctgggctggtcagacacctatcatctggccgggaaggtgcctggatgtctggggcctgaaaagcgggctgcctcagaagctctgtgactcctgcctgtcccagaagctgttagcttctgtggtacaaactctcacgtgtccagactattctgggctgagtcctggaaccaagatgtctcgcatgtgtccttaccggcttgaacatcatctagatatatgtccaggagatgtatttcaggaacctctaatagcactatgtccaatttttttgaggaaccacctgactgatttccagagtggttgtacaagcttgcaatcccaccaacaatggaggaatgttcctctttctccacatcttcaacagcatctgctgtcacctgaattttttatcatagccattctaactggtgaggaggcaactcagggttgttttgattttcatttccctgatgattaaggatgatgaacattctttcaggtgcttctctgccattcagtattcctaaggtgagaattcttttttcagctctgagccccatttttaatggggttatttgattttctggagtctaccttcttgagttctttatatatgttggatattagtcccccatttgagttaggatatgtaaagattctttcccaatctgttggtggtgtttttgtcttattggctgtgtcttttgccttgcagaaactttgcattttatgaggtcccatgtgtcgattctcgatcttacagcacaagccagccattgctattctattcaggaatttttcccctgtgcccatatttttgaggctttcccccaccttatcctctatatgtttcagtgtctctggttttatgtggagctcctttatccacttagatttgaccttagtacaaggagataggaatggatcaattcacattcttctgcatgataactgccggttgtgtcagcaccatttgttgaaaatgctgtcttttttccactggatggttttagctcccttgccaaagatcaagtgaccataggtgtgtgggttcatttatgggtcttcaattctactccgttagtctacttctctgtctctataccagtaccatgcagtttttatcacaattgctctgtagtacagctttaggtcatgcatggtgtctccatcagagattcttttatccttgagaagagttttagctatcctatggtttttctttttcttttttttttattccagatgaatatggagattgccctttccaattcgttgaagaactgaactggaattttgatggggattgcattgaatctgtagatttcttttggcaagatagccatttttactaaattgatcctgcatatccatgatcatgggagatctttccgtcttctgagatcttctttcatttctttcttcagagaattgaagttcttatcatacagatcatccatgtccttagttaggttcaagtcaaggtattttatattatttgtgactattgagaagggtgttgtttccctaatttctttctcagcctgtttatcctttgtgtagagaaaggccattgatatgtttgaggtaactttatatccagatacttcatttaacttgtttatcaggtttaggagtcctctggtggaatttttagggtcacttatataaactatcatatcatctgcaaaaagtgatattttgacttcttcctttccaatttgtatccccttgatctccttttgttgtcaaattactcttgctaggactaaaagtacaatgttgaataggtagtgagaaagtgtgcagccttgtctagtccctgattttagtgggattgcttccagcttgtcaccatttactttgatgttggctactggtttgctgtagattgcttttatcatttttagttatgggccttgaatttgtgatctttacaagacttttatcatgaatgggtgttggagtttgtcaaatgctttctcagcatctaaagagatgatcatgtttttttttttttttttttttttttactttgagtctgtttatataatggattatgttgacggatttctgtatattaaacaaaccctgcatcccttgaatgcaacttagttggtcaggttagatgattgttttgatgtgttctcagatttggttagcgagaattttattgaggatttttgcttcgatattcataagggaaatttgtctgaagttctctatctttgtttggtctttctgtggtttaggtatcagagtaattgtggcttcattgaatgagttgagtagagtaccttctgcttctattttgtggaatagtttgtgaagaactggaattagatcttccttgaaggtctgatggaactctgcactaaacccatctggtcctgggctttttttggttcagagactactaatgactgcttctatttctttaggggatataggactgtctagatcattaacctgatcctgatttaactttggtacctggtatctgtctagaaatttgtccatttcatccaggttctccagttttattgagtatagccttttgtagaaggatctgatggtgttttggatttcttcaagatctgttgttaagtctcccttttaatttctgagtttgttaattaggatgatgtccctgtgccctttagtgagtctggctaagggttcatctatcttgttgattttcttaaagaaccagctcctcatttggttgattctttgaatagttcttcttgtttccacttggttgattttgtccctgagtttgattatttcttgccatttactcctcttgggtcaatttgctttcttttgttctagagcttttaggtgtgttgtcaagctgctaatgtgtgctctctctagtttctttttggaggcactcagagctatgagttttcctcttagaaatgctttcattatgtcccataggtttgggtatgttgtagcttcattttcattaaactctaaaaagtccctaattcctttctttattcctttcttgaccaaggtatcattgagaagagtgttgttcagtttccaggtgaatgttggctttctaatatttatgttgttattgaagattagccttagtacatgttgatcttaaaggatgcacgggacaatttcaatatttttgtatctgttgaggcttgttttgtgaccatatggtcagttttggagaagataccatgaagtgctgagaagaaggtatatccttttgttttaggataaaatatttgtagatatctgttagatccatttgtttcataactccttttagtttcactgtatctctgtttagtttccgtttccatgatctgtacattgatgaaagtggtgtgttgaagtctcccactagtattctgttaggtgcaatgtgtgttttgagctttactaatgtttctgtaatgaatgcgactgcccttgtatttggagcatagatattcagaattgagagttcccttggaagattttacctttgatgagaatgaagtgcccctccttgtcttttttgatgactttggcttggaagtcgattttattagatattagaatggctacttcggcttgtttattcagacaatttgcttggaaaattgttttccagtctttcattctgaggtagggtctgtctttttccctaagatgggtttcctgtaagcagcagaatgttgggtcctgtttgtgtagccagtctgttattctatgtctatgtaattgttgcttcctattatttttgttgttaaagttggcattctgttcttggggctgtcgtctttttttttttttttttttttttttttttttttttttttttttaggtttcttgaaggattactttcttgctttttctaggacatggtttccatttttgtaatttttttctgttatcctttaaagggctggacttgtggaaagataatgtgtgaatttgttttgttgtggaatactttgttttctccatctatggtaggtaattaaaagtttggctgggtatagtagcctgggctggcatttgtgttctcttagtgtcagtataacatctgtgcaggatattctggctttcatagtctctggtgaaaaatctggtgtaatactgataggtctgcctttatatgttacttgacctttttcccttactgcttttaatattctatctttatttagtgcatttgttgttctgatgattatgtgtcgggaggaatttcttttctggtccagtctatttggagttctgtaggcttcttgtatgttcatgggcatctttttctctaggcttgggaagttttcttctataattttgttgaggttatttgctggccctttaagttgaaaatcttcattctcatcaattcctattatccgtaggtttggtcttctcattgtgtcctggatttcctggatgttttgagttaggatctttttgcattttccattttctttgattgttgtgctgatgttctttatggaatcttctgcacctgagattctctctttcatctgttgtattctgttgctgatgctcgcatctatgtttcaagatttctttcctaggatttctatctccagtgttgcctcactttgtgttttctttattgtgtccacttcccttttaggtctaatatggttttgttcatctccatcacctgtttggaagtgttttcctctttttctttaaggacttgtaattctttagcagtactctcctgtatttctttaagtgagttattaaagtccttcttgatgtcctctgccatcatcacgagatatgcctttaaatctcggtctagcttttagggtgtgttaaggtacccaggactggttgaggtgggagtgctgggttctaatgatggtgagttgtcttggtttttgttggtaagattctttttttttccatttttattaggtatttagctcatttacatttccaatgctataccaaaagtcccccatacccacccacccccactccactacccacccacaccccctttttggccctggcgttcccctgtactggggcatataaagtttgcgtgtccaatgggcctctctttccagtgatggccgactaggccatcctttgatacatatgcagctagagtcaagagctccggggtactggttagttcataatgttgttccacctatagggttgcagatccctttatctccttgggtactttctctagctcctccattgggagccctgtgatccatccgttagctgactgtgagcatccacttctgtgtttgctaggccccggcatagtctcacaagagacagctacatctgggtcctttcgataaaatcttgctagtgtatgcaatggtgtcagcgtttggatgctgattatggggtggatccctggatatggcagtctctacatggtccatcctttcatctcagctccaaactttgtctctgcaactccttccatgggtgttttgttcccacttctaaggaagggcatagtgcccacacttcagtcttcatttttcttgagtttcatatgtttaggaatttgtatcttatatcttgggtatcctaggttttgggctagtatccacttatcagtgagtacatattgtgtgagttcctttgtgaatgtgttacctcactcaggatgatgccctccaggtccatccatttggctaggaatttcataaattcattctttttaatagctgagtagtactccattgtgtagatgtaccacattttctgtatccattcctctgttgaggggcatctgggttctttccagcttctggctattataaatatggctgctatgaacatagtggagcatgtgtccttcttaccagttggggcatcttctggatatatgcccaggagaggtattgctggatcctccggtagtactatgtccaattttctgaggaaccgccagactgatttccagagtggttgtacaagcctgcaatcccaccaacaatggaggagtgttcctctttctccacatccacatcagcatctgctgtcacctgaatttttgatcttagccattctgactggtgtgaagttgaatctcggggttgttttgatttgcattttcctgatgattaaggatgttgaacattttttttttcaggtgcttctctgccattcggtattcctcaggtgagaattctttgttcagttctgagccccattttttaatggggttatttgattttctgaaggccaccttattgagttctttatatatgttggatatatattagtcccctatctgatttaggataggtaaagatcctttcccaatctgttggtggtctttttgtctcattaacagtgtcttttgccttgcagaaaatttggagtttcattaggtcccatttgtcaattcttgatcttaaagcacaagccattactgttctgttcaggaatttttcccctgtgcccatatcttcaaggcttttccccactttctcctctataagtttcagtgtctctggttttatgtgaagttccttgatccacttagatttgaccttagtacaaggagataagtatggatcgattcgcattcttctacatgataacaaccagttgtgccagcaccaattgttgaaaatgttgtctttcttccactggatggttttagctcccttgtcgaagatcaagtgaccataggtgtgtgggttcatttttgggtcttcaattctgttccatttgtctacttgtctgtcactataccagtaccatgaagtttttatcacaattgctttgtagtaaagctttaggtcaggcatggtgattccaccagaagttcttttatccttgagaagagtttttgctatcctcgtttttttgttattccagatgaatttgcaaattgctccttctaattcgttgaagaattgagttggaattttgatggggattgcattgaatctgtagattgcttttggcaagatagccatttttacaatgttgatcctgccaatccatgagcatgggagatctttccatcttctgagatcttctttaatttctttcttcagagacttgaagtttttatcatacagatctttcacttccttagttagagtcacgccgagatattttatattatttgtgactattgagaagggtgttgtttccctaatttctttctcagcctgtttattctttgtatagagaaaggccattgacttgtttgagttaattttatatccagctacttcaccgaagctgtttatcaggtttaggagttctctggtggaatttttagggtcacttatatatactatcatatcatctgcaaaaagtgatattttgacttcatcttttccaatttgtatccccttgatctccttttgttgtcgaattgctctggcgaatacttcacgtcctatgttgaaaaggtatggagaaagttggcagccttgtctagtccctgattttagtgggattgcttccagcttctctccatttactttgatgttggctactggtttgctgtagattgcttttatcatgtttaggtatgggccttgaattcctgatctttccaaaacttttatcatgaatgggtgttggatcttgtcaaatgctttttctgcatctaacgagatgatcatgtggtttttgttttttagtttgtttatatactggtttacattgatggatttccatatattaaaccatccctgcatccctggaataaaacctacttggtcaggatggatgattgctttaatgtgttcttggattcggttagtgagaattttattgaggatttttgcattgatattcataagagaaattggtctgaagttctctatctttgttggatctttctgtggtttaggtatcagagtaatagtggcttcataaaatgagttgggtagagtaccttcttcttctatcttgtgaaaaagtttgtgcagaactggaattagatcttctttgaaggtctgatagaactctgcactaaacccgtctggtcctgggctttttttggctgggagactattaataactgcttctatttctttaggggatatgggactgttaagaaggttaacttgatcctgattctactttggtacctggtatctgtccagaaatttgtccattttgtccaggttttccagttttgttgagtatagccttttgtagaaggatctgatggtgttttggatttcttcaggatctgttgttatgtctcccttttcagttttgattttgttaattaggattttgtccctgggccctctagtgagtctagctaagggtttatctatcttgttgattttctcaaagaaccaactcctcgtttggttaattctttgaatagttcttcttgtttccacttggttgatttcacccctgagtttgattatttcctgccgtctactcctcttgggtgaatttgcttcctttttttctagagcttttagatgtgttgtcaagctgctagtatgtgttctctcccgtttcttcttggaggcactcagagctatgagtttccctcttagaaatgctttcattgtgtcccataggtttgggtatgttgtggcttcattttcattaaactctaaaaagtctttaatttctttctttattccttccttgaccaaggtatcattgagaagagtgttgttcagtttccacgtgaatgttggctttccattatttatgttgttattgaagatcagtcttaggccatggtggtctgatagaatacatgggacaatttcaatatttttgtatctgttgaggcctgttttgtgaccaattttatggtcgattttggagaaggtcccgtgaggtgctgagaagaaggtatatccttttgttttaggataaaatggtctgtagatatctgtcaggtccatttgtttcataacttctgttagtttcactgtgtacctgtttagtttctgtttccacgatctgtccattgataaaagtggtgtgttgaagtctcccactattattgtgtgaggcgcaatgtgtgctttgagctttactaaagtgtctttaatgaatgtggctgcccttgcatttggagcgtagatattcagaattgagagttcctcttggaggattttacctttgatgagtatgaagtgtccctccttgtcttttttgataactttgggttggaagtcgattttatccgatattagaatggctactccagcttgtttcttcagaccatttgcttggaaaattgttttccagcctttcactctgaggtagtgtctgtctttttccctgagatgggtttcctgtaagcagcagaattttgggtcctgtttgtgtagccagtctgttagtctatgtctttttattggggaattgagtccattgatattaagagatattaaggaaaagtaattgttgcttctttttatttttgttgttagggttggcattctgttcttgtggctgtcttctttttggtttgttgagggattactttcttgcttgttttagggcgttaattccgtccttgtattgcttcttttctgttattatcctttgaagggctggattcttagaaagatattgtgtgaatttggttttgtcgtggaatactttggtttctccatctatggtaattgagagttttgccgggtatattagcctgggctggcatttgtgttctcttagtgtctgtataacatctgtccaggctcttctggctttcatagtctctggtgaaaagtctggtgtaattctgataggccttcctttatatgttacttgacctttctcccttactgcttttaatattctatctttatttagtgcatttgttgttctgattattatgtgtcgggaggaatttcttttctggtccagtctatttggagttctgtaggcttcttgtatgatcatgggcatctctttctttatgtttgggaagttttcttcaattattttgttgaagatattagctggccctttaagttgaaaatcttcattctcatcaattcctattatccgtaggtttggtcttctcattgtgtcctggattacctggatgttttgagttaggatccttctgcattttgtattttctttgactgttgtgtcgatgttctctatggagtcttctgcacctgagattctctcttccatttcttgtattctgttgctgatgctcgcatctatggttccagatctctttcctagggtttctatctccagcgttgcctcgctttgggttttctttattgtgtctacttccctttttagttctagtatggttttgttcatttccatcacctgtttggatgtgttttcctgtttttctttaaggacttctacctgtttggttgtgttttcctgcttttcttgaagtgcctgtaactctttagcagtgctctcctgtaattctttaagtgacttatgaaagtccttcttgatgtcctctatcatcatcatgagaaatgtttttaaatcttggtctagattttcggttgttttggggtgcccaggactaggtggggtgggaatgctgcgttctgatgatggtgaatggtcttgatttctgttagtaggattcttacatttgcctttcgccatctggtaatctctgaagctagctgttatagttgtcactgttaagagcttgttcttcaggtgactctgttagcctctataagcagacctgggagggtagctctctccttagtttcagtgggcagagtattctctgcaggcaagctctcttcttgcagggaaggtacccagatatttggtgttcgaaccggcctcctggcaggcactgtgttccactcaccagaggtcttaggatcccgtggggaatcctgtgtgggcccttgcagttgtcgggcgagtccgctggcaaggtaccccggggctcgagtggagcagaaggggcttgtgccccaggtcaggcccgggtagtctgcttccctatttcccacagtctcaggttctgcgtgattggattggggcaggcgctgtgttccactcaccagaggtcttaggatcccgtggggaatcctgtgtgggcccttgcgggtgtagggcgagtccgctggcaaggtaccctggggctcgagtggagcagaaggggcttgtgccccaggtcaggcctgggtagtctgcttccctatttcccacagtctcaggttctgcgcaattggattggggcaggcgctgggttccactcaccagaggtcttaggatcccatggggaatcctgtgtgggcccttgcgggtgtcgggcgagtctgctggcaaggtcgttagtaagattcttatgtgtgcctttcgccatctgataatctctggagtcagtttttttttagttgtctctggttagagcttgttcctttcgtgattatcttagcctctaccagcagacctgggagactagatctctcctgagtttcagtggttagagtactctctgcaggcaagttctcctcttgcagagaaggtgcacatgttggacttgcctcctggcagaagatgaagtcccgaagcagggcctgtcccagaagctgttagcttctgtcgtccacactctcactgtgcagactagtcttggcaggattcaggaatgaagatggctcctgcagatgctccatcaaagccctcctggacggggtggacacttcttttctggcagggaaggtgcctggatatctgcagcctgaaacagggtctgccacagaagttctgtggctcctgcctgtcccagatgctgttagcttttgtagtccacactctcacctgtgcagactagtcttggcagcatccgggaacaaagatggctcccgcagatgctctccaggattctcttttattttatagaaaatattaacttctgagggagaacatgccatatatttctggatttagcttaccttactcagggtgattttttttctaggtccatccatttacctacaaaatttatgttgccatttttttaacactgtttttagtaaatgtactgtattttcttcgggggggaggtattgagccagggtttctctgtagctctgtctgtcctggaactcactctatagatcaggccagcctcaaactcagaaatctgcctgatgctgccttccctatgcttggaataaaggtgtgcgccacgatgcctggcactgttttttttgtttgtttgttttttgttttttttacccatttttctgtttagtgacatctacatagttttcagtttttcgttattaggaatatgtgtgctatgtacatagttcaacaagtgtccttgtgataggatggaacatactttgtgtttattgcccaggtgtggtataagtaggtcatgaagtagattaatttccaattttctgagaaaactccatattgacttctaaagtgactgtataaggttacattaccattatcactgtaaaatcttgcttgttggttcccatccttgccagcatgagcaggcacttgacattcttatactagaaattctgacaggtgtaacatagaattacaaaataatttagaatttaaatctccggatagttttgaatgttacctaagaagaatttcttgaaatgaagttcatctgttaataattctgggtttagatctgtacctccttttttactggaatgtttgttttatagatttcttcttgaatttttatgtattttggatattagacatctgtcagatgtgaagttggtgaagatatcttcaaattctataggccaaaataagtaatgttgaagatgtcttttgttatacagaaggccatcagttgcatgatatctcatgtataaaagattactcttagagcctatgatactagtgttttatcatgaaaatatattctatacttagtaattaaaggttacccattctatgttcccttttagtaggttcagtgtatgtagagaagatgctacataagtgctggggaccaggaaccgcccatgtgtgctatttgtttgatgactcagtttttggaaaatattccgggtctaggttgctgctacagttggtattccatcccctacagcattttcaagtccttaccttaactgttctatagaagtcacttaattcagtccaatgatggactgtaagtatacattctatctcaggtaattgctggtagggacttacagagaataaatgtacacaagttgaaacaagcaaaaatagaagaagttgatcaaggagagagagaaggagagagagagagagagagagagagagagagagagagagagagagagagagagagagagagaggtgcttttcagctgaccctaattaagcctgctacctatgaggtagaattatgaaccctcagaggagattgattttgcatcatgcaaagatccagaagtattgatcagagaaggactggagccatgattgaaggctcaaaagttgtttgcttagatatccatggaggcccaatttggctggtggacttattcagagctgcctcctccttcttcgtcaaaaaggcaaggggaccaatgattgcccttgttattggctttttctgactggataattggagaagagccttcattcccttgaaaactttgctcaagacactggtggaggaagttgatggcttggacctaagagaaagtgttgagtacctgtattgcagctcacatatcatccttaagtccttagagggagctgaggacccagcaagcacttgagagcagagggcgtggcatgttcacatccaaggcctgagagtaacagcaagtgagatctggaagggcagtgtgaagaggttggtaagagcaggagtgttgagggtgcctgtgagatatgacaagcccatagtacatggtaagcccataatccatgtggttttgcattggtcccactgtaattggggcatgttctctgtgctgtcatcacagggttgcattccctttccagtatggtacatggaaaacatgcagaggaaatggccccacagcattggctgagtgtttatgtcgtccaaccgagtctccatcgaacagttgtggtatggtgacttggcctaggtcacctgagttaaaaggtaaggaacatgggaattgctgcatgaattctaggtgcccaggtcttggtggagcagggaacggctgccattgatatgtccaggccttttgggacatggagcatgcctagggcctctgctttctcccaggtttggagcttcggcccattgttccctggcagtggattggcagtgtccagaagtccattgctctccccaaagccagagcactccagagtactggaacaactttatgcaatgcactccaacgtgcttggatctatgatgattcccagtcaaacattccttggaaaagctgaacaaaatgagtgaaaactctgtaccgccaatcacataggaactgaggtccagcatcttgggtctcccaggtgctatgggcgtcaggcacaggctgcccaaccactccattgttcctgacttcttcgggctctagccagactctccagagacaggtgagtgcttggcctactctgccaaaaatccatggcgtaggacacagcaggtccttaagctctggtggcttgctccctttgctgtagtggagatgcttggcagatactcagtaggtagtcgtgctaggtccaaggagagggccccagccattgtggaatgtagactgtgaggcaaaagtagcagtggcagtggcaccaaatcttggcctttcacatgggaatatctggcagtggactcaggcttctcagaagcacttatatgaattttaaccctgttgcattgctttacgtagtcaatagaatgcaggctgctggtagagtatagcttgaccctgtagcatgtaaacgggactgtgtaaatgttgtctgttcaggtggtgaacagaagcctctgtgtccctggcagcttggaagattcccgggcgattggcttggaaatagagaaggagctaagccttggaggtgatggcaggcacctcacgggtcagtttgcaccacatttaaacacttacctgggtctgtagacagaagaaactttgatggactcgctgggagcatgagactcgcagacctgtgtctcgatagatttggtgaaataacttttgttggaatctcttctttggtagttgctgttgctttggatgttgttgaagggatatccttggtatatttggaccttgttgtcagcctccttggcaaggtcaaagggaaagtctaggaacagttcttgcacccacagccttaggagaaccatcttggtgagggaccctctaaattagagaccaaggtgtcatgggacctttcttttcgatgttttggactaactcttctggaaagacaagttgctagtgtgcataggaaggaggtttcaacagggcacatcgtgttttgcaaatccaccttgagagccaatctcacgggaatcatcagggagaacataatttcttggatgcagactgcatttgacacactaagataacttgagtcaagtcggatcctggcctgtggtagttctgcacaatgggattttcattagtgtgagaagctgagcagtatagtctgagaagttttcaccagaagagctcaaagcaggggtagatggccaaaagcaatctcatgagagaggtggaagtcttcacaacagacaaaatgagcactggacaggtggacagaaatagggactggctgccacagcaaggaatgtctcagggtaaaagacacacacacacacacacacacacacacacacacacacacacacatacacacacacacacacacacactaacacagagagaaggagagggggggattcttttcagctgtgaaaatgaagcctgcttcccatgagctggaattctgaaccctcagaggagtttgattttacctcatggaaagacccagaagtaatgatcagaggactggagcaatgattgaaggctcaaaagttgtttgcttagatatccatggaggcccaattttgctggtggaattattcagagctgcctccttcttcttcgtcagcataagcaagtggacctatgattgcccttgtttttggctttttctgactggatgcttggagatgagccttcatttccctgaaaactttgctcaggacactggtggaggaagttgatggcttggacctaagagaaaatgatgagtatctgtatttcacctcacatatcatcgtaaagtccttagagggagctgagtatcaagcaagcacttgagagcaaagggcatgacatgttcacatccaaggccggagagtaacagcaagtgagatctggaagggcagtgtgaagaagttggtaagagcaggagttttgagggtgtctgtgagatatgacaagcccaaagtacatggtaagcccataatccatgtggatttgaattggtcccaatgtaatcagggcatgttctctgtgctctcttctagggctgcattccctttctagtatggtccatgaaaaacatgcagaggaaatggccccaaagcattggctgagagtttatgtcgtccaactgagtctccattgaactgttgtggtgttgctgacttgccctaggtcacctgagttaaaaggtaaggaacatgggaattgctgcatgaattctaggtgcccaggtcttggtggagcagggaacggctgccattgattatgtccaggcccttcgggacatggagcatgcctagggccctggtttctcccatgtttggagctttggcccattgttccctggcagtagattggcagtccagcagtccattgctctccccaaagccaaagcactccagagtactggaaccacttgatgcaatgcactccaacgagcttggatctatgatgattcccagtcaaacattccttggaaaagctgaacaaaatgagtgaaaactctgtaccgccactctcatcggaactgaggtccagcatcttgggtctcccaggtgctatgggcgtcaggcacaggctgcccaaccactccattgttcttgacttcttcgggctctagccagactctccagagacaggtgtgtgcttggcctattctgacaaaaatccatggtctaggacacagcaggtccttaagctctggtggcttgctccctttgctgtagtggagatgcttggcagatactcagtaggtagtcgtgctaggtccaaggagaggaccccagccattgtggaatgtagactgtgaggcaaaagtagcagtggcagtggcaccaaatcttggcctttcacatgggaatatctggcagtggactcaggcttctcagaagcacttatatgaatttaaaccctgttgcattgctttacgtagtcaatagaatgcaggctgctggtagagtgtaacttgacccagtagcatgtaaacgggactgtgtgaatgttgtctgttcaggtgatgaacagaagcctctgtgtccctggcagcttggatgtttcccgggcgattggcttggaatagagaaggagctaagccttggaggtgatggcaggcacctcacgggtcagtttgcaccacatttacacacttacctgtgtctgtagatggatgaaactttgatgaactcgctgggagcatgagacttgcagacctgtgtctcgatagatttgttgaaataactttggtaggaaactcctctttggtaggtgctgttgctttggatgttgttgaagggatatccttggtatatttggacatagttgtcagcctccttgtctaggtcaaagggaaagtctaggaacagttcttgcacccacagccttaggagaaccatcttggtgagggaccctctaatttagagaccaaagtgtcatgggacctttcttttcaattttttggcctaacagttctggaaaggcaagttgatagtgtgcataggaaggaggtttcagcagggcacatcgtgttttgcaaatccaccttgagagccatgctcatggggatcatcagggagaaaataagttcttggatgcagactgcatttgacacactaagataacttgagtcaagttggatcctggcctgtgataattctgcacgatgggattttcaatagtgtgagaagctgagcagtatagtctgagaacttttcaccagaagagatcaaagtaggggtggatggccaaaagcaatctcatgagagaggtggaagtcttcacaacagacaaaatgagcactggacaggtggacagaaatagggactggctgccacagcaaggaatgtctcagggtaaaagacacacacacacaaacacacacatacacacacacacacacacactaacacagagagaaggagagagaggggggattcttttcagctgtgcaaatgaagcctgcttcccatgagctggaattctgaaccctcagaggagtttgattttacctcatgcaaagacccagatgtaatgatcagagaaggactggagccatgattgaaggctcaaaatttgtttgcttagatatccatggaggcccaattttgctggtggacttattcagagctgcctcccccttcttcttcagcataggcaaggggccctatgattgcccttgttattggctttttctgactggatgcttggataagagccttcattcccttgaaaactttgctgaggacactggtggaggaagttgatggcatggacgtaagagaaagtgttgagtacctgtattgcagatcacatatcatccttaagtccttagagggagctgaggacccagcaagcacttgagagcaaagggcatggcatgttcacatccaaggcctgagagtaacagcaagtgagatctggaagggcagtgtgaagaggttggtaagagcaggagtgttgagggtgcctgtgagatatgacaagcccatagtacatggtaagcccataatccatgtggttttgcattggtcccactgtaatcggggcatgttctctgtgttgtcttcacagggttgcattccctttccagtatgatccatagaaaacatgcagaggaaatggccccacagcattggctgagtgtttatgtcgtccaactgagtctccatcgaactgttgtggtgttgctgacttgccctaggtcacctgagttaaaaggtaaggaacatgggaattgctgcatgaattctaggtgcccaggtcttggtggagctgggaacggctgccattgatatgtccaggcccttcaggacatggagcatgcctagggcgtctggtttctcccaggtttggagcttcggcccattgttccctggcagtggattggcagtgtccagcagtccattgctctccccaaagccaaagcactccagagtactggaaccactttatgcaatgcactcccacctgctcggatctatgatgattcccagtcaaacattccttggaaaagctgaacaaaatgagtgaaaactctgtaccgccactctcatcggaactgaggtccagcatcttgggtctcccaggtgctatgggcgtcaggcacaggctgcccaaccactccattgttcttgacttcttcgggctctagccagactctccagagacaggtgtgtgcttggcctattctgacaaaaatccatggtctaggacacagcaggtccttaagctctggtggcttgctccctttgctgtagtggagatgcttggcagatactcagtaggtagtcctgctaggtccaaggagaggaccccagccattgtggaatgtagactgtgaggcaaaagtagcagtggcagtggcaccaaatcttggcctttcacatgggaatatctggcagtggactcaggcttctcagaagcacttatatgaatttaaaccctgttgcattgctttacgtagtcaatagaatgcaggctgctggtagagtgtaacttgacccagtagcatgtaaacgggactgtgtgaatgttgtctgttcaggtgatgaacagaagcctctgtgtccctggcagcttggatgtttcccgggcgattgtcttggaatagagaaggagctaagccttggaggtgatggcaggcacctcacgggtcagtttgcaccacatttacacacttacctgtgtctgtagatggatgaaactttgatgaactcgctgggagcatgagacttgcagacctgtgtctcgatagatttgttgaaataactttggtaggaaactcctctttggtaggtgctgttgctttggatgttgttgaagggatatccttggtatatttggacatagttgtcagcctccttgtctaggtcaaagggaaagtctaggaacagttcttgcacccacagccttaggagaaccatcttggtgagggaccctctaatttagagaccaaagtgtcatgggacctttcttttcaattttttggcctaacagttctggaaaggcaagttgatagtgtgcataggaaggaggtttcagcagggcacatcgtgttttgcaaatccaccttgagagccatgctcatggggatcatcagggagaaaataagttcttggatgcagactgcatttgacacactaagataacttgagtcaagttggatcctggcctgtgataattctgcacgatgggattttcaatagtgtgagaagctgagcagtatagtctgagaacttttcaccagaagagatcaaagtaggggtggatggccaaaagcaatctcatgagagaggtggaagtcttcacaacagacaaaatgagcactggacaggtggacagaaatagggactggctgccacagcaaggaatgtctcagggtaaaagacacacacacacaaacacacacatacacacacacacacacacactaacacagagagaaggagagagaggggggattcttttcagctgtgcaaatgaagcctgcttcccatgagctggaattctgaaccctcagaggagtttgattttacctcatgcaaagacccagatgtaatgatcagagaaggactggagccatgattgaaggctcaaaatttgtttgcttagatatccatggaggcccaattttgctggtggacttattcagagctgcctcccccttcttcttcagcataggcaaggggccctatgattgcccttgttattggctttttctgactggatgcttggataagagccttcattcccttgaaaactttgctgaggacactggtggaggaagttgatggcatggacataagagaaagtgttgagtacctgtattgcagatcacatatcatccttaagtccttagagggagctgaggacccagcaagcacttgagagcaaagggcatggcatgttcacatccaaggcctgagagtaacagcaagtgagatctggaagggcagtgtgaagaggttggtaagagcaggagtgttgagggtgcctgtgagatatgacaagcccatagtacatggtaagcccataatccatgtggttttgcattggtcccactgtaatcggggcatgttctctgtgttgtcttcacagggttgcattccctttccagtatgatccatagaaaacatgcagaggaaatggccccacagcattggctgagtgtttatgtcgtccaactgagtctccatcgaactgttgtggtgttgctgacttgccctaggtcacctgagttaaaaggtaaggaacatgggaattgctgcatgaattctaggtgcccaggtcttggtggagctgggaacggctgccattgatatgtccaggcccttcaggacatggagcatgcctagggcgtctggtttctcccaggtttggagcttcggcccattgttccctggcagtggattggcagtgtccagcagtccattgctctccccaaagccaaagcactccagagtactggaaccactttatgcaatgcactcccacctgctcagatctatgatgatttccagtcaaacattccttggaaaagctgaacaaaatgagtgaaaactctgtaccgccactctcatcggaactgaggtccagcatcttgggtctcccaggtgctatgggcgtcaggcacaggctgcccaaccactccattgttcttgacttcttcgggctctagccagactctccaaagacaggtgtgtgcttggcctattctgccaaaaatccatggtctaggacacagcaggtccttaagctctggtggcttgctccctttgctgtagtggagatgcttggcagatactcagtaggtagtcgtgctaggtccaaggagaggaatccagccattgtggaatgtagactgtgaggcaaaagtagcagtggcagtggcaccaaatcttggcttttcacatgggaatatctggcagtggactcaggcttctcagaagcacttatatgaatttaaaccctgttgcattgctttacgtagtcaatagaatgcaggctgctggtagagtgtaacttgacccagtagcatgtaaacgggactgtgtgaatgttgtctgttcaggtgatgaacagaagcctctgtgtccctggcagcttggaagtttcccgggtgattggctaggaaatagagaaggagctaagccttggaggtgatggcaggcacctcacgggtcagtttgcaccacatttacacacttacctgtgtctgtagatggatgaaactttgatgaactcgctgggagcatgagacttgcagacctgtgtctcgatagatttgttgaaataactttggtaggaatctcctctttggtaggtgctgttgctttggatgttgttgaagggatatccttggtatatttggaccttgttgtcagcctccttggcaaggtcaaagggaaagtctaggaacagttcttgcacccacagccttaggagaaccatcttggtgagggaccctctaaattagagaccaaggtgtcaggggacctttcttttcgatgttttggcctaacacttatggaaagacaagttgctagtgtgcataggaaggaggtttcaacagtgcacatcgtgttttgcaaatccaccttgagagccatgctcatgggaatcatcagggagaaaataagttcttggatgcagactgcatttgacacactaagataacttgagtcaagtcggatcctggcctgtgatagttctgcacaatgggattttcattagtgtgagaagctgagcagtatagcctgagaactttcaccagaagagatcaaagcaggggtggatggccaaaagcaatctcatgagagaggtggaagtcttcacaacagacaaaatgagcactggacaggtggacagaaatagggactggctgccacagcaaggaatgtctcagggtaaaagacacacacacacacacacacacacacacacacgcacacagacacacacacacacacacactaacaaagagagagggagagagagggggttcctttcagctgtgaaaatgaagcctgcttccaatgagctggaattctgaactctcagaggagtttgattttacctcatgcaaagacccagaagtaatgatcagagaaggactggagccatgattgaaggctcaaaagttgttggcttagatatccttggaggcccaattttgctggtggagttattcagagctgcctcctccttttttgactgcataggcaaggggacctctgattgcccttgttattggttttttctgactggatgcttcgagaagagccttcattcccttgaaaactttgcttaggacactggtggaggaagttgatgacatggacctaagagaaagtgttgagtacctgtattgcagctcacatatcatccttaagtccttagagtgagctgaggaccaagcaagcacttgagagcaaagggcatggcatgttcacattcaaggcctgagagtaacagcaagtgagatctggaaaggcagtgtgaagaggttggtaagagcaggagtgttgagggtgcctgtgagatatgacaagcccatagtacatggtaagcccataatccatgtggttttgcattggtcccactgtaatcggggcatgttctttgtgttgtcttcacagggttgcattccctttccagtatggtccatggaaaacatgcagaggaaatggccccacagcattggctgagtgtttatgtcgaccaacttagtctccatcgacctgttgtggtgttgctgacttgccctaggtcacctgagttaaatggtaaggaacatgggaattgctgcatgaattctaggtgcccaggtcttggtggagcaggtaacggctgccattgaatatgtccaggcccttcgggacatggagcatgcctagggcctctggtttctcccatgtttggagcttcggcccattgttccctggcagtggattgtcagtgtccagaagtccattgctctccccaaagccagagcactccagagtacaggaaccacttgatgcaatgcactccaacgagcttggatctatgatgattcccagtcaaacattccttggaaaagctgaacaaaatgagtgaaaactctgtaccgccactctcatcggaactgaggtccagcatcttgggtctcccaggtgctatgggcgtcaggcacaggctgcccaaccactccattgttcttgacttcttcgggctctagccagactctccagagacaggtgtgtgcttggcctactctgccaaaaatccatggcgtaggacacagcaggtccttaagctctggtggcttgctccctttgctgtagtggagatgcttggcagatactcagtaggtagtcatgctaggtccaaggagagggccccagccattgtggaaagtagactgtgaggcaaaagtagcagtggcagtggcaccaaatcttggcttttcagatgggaatatcaagcagtggactcaggcttctcagaagcacttatatgaattttaaccctgttgcattgctttacgtagtcaatagaatgcaggctgctggtagagtgtagcttgacccagtagcatgtaaatgggactgtgtgactgttgtcatttcaggtggtgaacagaaggctctgtgtccctggcagcttggatgtttccccggggggttgctaggaaatagagaaggagctaagccttggaggtgatggcaggcacctcacgggtcagtttgtaccacatttacacatttacctgtgtctgtagacggatgaaactttgatggactcgctggcagcatgagacttgcagacctgtgtctccatagatttgttgaaataatttttgtaggaatctcctctttggtaggtgctgttgctttggatgttgttgaagggatatccttggtatatttggacattgttgtcagcctccttggcaaggtcaaagggaaagtctaggaacggttcttgcacccacagccttaggagaaccatcttggcgagggaccctctaaattagagaccaaggtgtcatgggacctttcttttcgatgttttggcctaactcttctggaaagacacgttgctagtgtgcataggaaggaggtttcaacagggcacatcgtgttttgcaaatccaccttgagagccatgctcatgggaatcatcagggagaaaataagttcttggatgcagactgcatttgacacactaagataacttgagtcaagtcggatcctggcctgtgatagttctgcacaatgggattttcattagtgtgagaagctgagcagtatagtctgagaacttttcaccagaagagatcaaagcaggggtggatggccaaaagcaatctcatgagagaggtggaagtcttcacaacagacaaaatgagcactggacaggtggacagaaatagggactggctgccacagcaaggaatgtctcagggtaaaagacacacacacacacacacacacacacactaacacagagagagggagagagaggggggttcctttcagctgtgaaaatgaagcctgcttcccatgacctggagtctgaactctcagaggagtttgattttacctcatgcaaagacccagaagtaatgatcagagaaggactggagccatgattgaaggctcaaaagttgttggcttagatatccttggaggcccaattttgctggtggagttattcagagctgcctcctcctttttcgactgcataggcaaggggacttatgattgcacttgttattggttttttctgactggatgcttggagagagccttcattcccttgaaaactttgctcaggacactggtggatgaagttgatggcatggatctaagagaaagtgttgagtacttgtattgcagctcacatatcatccttaagtccttagagtgagctgaggacccagcaagcacttgaaagcaaagggcatggcatgttcacatccaaggcctgagagtaacagcaagtgagatctggaagggcagtgtgaagaggttggtaagagcaggagtgttgagggtgcctgtgagatatgacaagcccatagtacatggtaagcccataatccatgtggtattgcattggtcccactgtaatcagggcatgttctttgtgttgtcttcacagggttgcattccctttccagtatggtccatggaaaacatgcagaggaaatggccccacagcattggctgagagtttatgtcgtccaactgagtctccatcgaactgttgtggtgttgctgacttgccctaggtcacctgagttaaatggtaaggaacatgggaattgctgcatgaattctaggtgcccaggtcttggtggagcagggaacggctgccattgattatgtccaggcccttcgggacatggagcaggcctagggcctctggtgtctcccatgtttggagcttcggcccattgttccctggcagtggattgtcagtgtccagcagtccattgctctccccaaagccagagcactccagagtactggaaccacttgatgcaatgcactccaacgagcttggatctatgatgattcccagtcaaacattccttggaaaagctgaacaaaatgagtgaaaactctgtaccgccactctcatcggaactgaggtccagcatcttgggtctcccaggtgctatgggcgtcaggcacaggctgcccaaccactccattgttcttgacttcttcgggctctagccagactctccagagacaggtgtgtgcttggcctactctgccaaaaatccatggtgtaggacacagcacgtccttaagctctggtggcttggtccctttgctgtagtggagatgcttggcagatactcagtaggtagtcgtgctaggtccaaggagagggccccagccattgtggaaagtagactgtgaggcaaaagtagcagtggcagtggcaccaaatcttggcttttcacatgggaatatcaagcagtggactcaggcttctcagaagcacttatatgaattttaaccctgttgcattgctttacgtagtcaatagaatgcaggctgctggtagagtgtagcttgacccagtaacatttaaacgggactgtgtgactgttgtcggttcaggtggtgaacagaaggctctgtgtccctggcagcttggaagtttcccgggggattggctaggaaatagaggaggagctaacctttggaggtgatggcaggcacctcacgggtcagtttgcaccacatttacacacttacctgtgtctgtagacggatgaaactttgatggactcgctggcagcatgagacttgcagacctgtgtctcgatagatttgttgaaataactttggtaggaatctcctctttggtaggtgctgttgctttggatgttgtggaagggatatccttggtatatttggaccttgttgtcagcctgcttggcaaggtcaaagggaaagtctaggaacagttcttgcacccacagccttaggagaaccatcttggtgagggaccctctaaattagagaccaaggtgtcatgggacctttcttttcgatgttttggcctaactcttctggaaagacaagttgctagtgtgcataggaaggaggtttcaacagggcacattgtgttttgcaaatccaccttgagagccatgctcatgggaatcatcagggagaaaataagttcttggatgcagactgcatttgacacactaagataacttgagtcaagtcggatcctggcctgtgatagttctgcacaatgggattttcattagtgtgagaagctgagcagtatagcctgagaacttttcaccagaagagatcaaagcaggggtggatggccaaaagcaatctcatgagagaggtggaagtcttcacaacagacaaaatgagcactggacaggtggacagaaatagggactggctgccacagcaaggaatgtctcagggtaaaagacacacacacacacacacacacacacacacacacattaacacagagagagggagagagaggggggttcctttcagctgtgaaaatgaagcctgcttcccatgagctgtaattctgaactctcagaggagtttgattttacctcatgcaaagtcccagaagcaatgatcagagaaggactggagccatgattgaaggctcaaaagttgttggcttagatatccttggaggcccaattttgctggtggagttattcagagctgcctcctccttcttcgactgcataggcaaggggacctatgattgcccttgttattggctttttctgactgcatgcttggagaagagccttcattcccggtaaaactatgctcaggacactggtggaggaagttgatggcaaagacctaagagaaagtgttgagtaccagtattgcagctcacatatcatccttaagtccttagagtgagctgaggacccagcaagcacttgagacaaagggattggcatgttcacatccaaggcctgagagtaacagcaagtgagatctggaagggcagtgtgaagaggttggtaagagcaggagtgttgagggtgcctgtgagatatgacaagcccatagtacatggtaagcccataatccatgtggttttgcattggtcccactgtaatcagggcatgttctttgtgttgtcttcacagggttgcattccctttccagtatggtccatggaaaacatgcagaggaaatggccccacagcattggctgagtgtttatgtcgtccaactgagtctccatcgaactgttgtggtgttgctgacttgccctaggtcacctgagttaaatggtaaggcacatgggaattgctgcatgaattctaggtgcccaggtcttggtggagcagggaacagctgccattgattatgtccaggcccttcgggacatggagcatgcctagggcctctggtttctcccatgttttgagctttggcccattgttccctggcagtggattgtcagtgtccagcagtccattgctctccccaaagccagagcactccagagtactggaaccacttaatgcaatgcactccaacgagcttggatctatgatgattcccagtcaaacattccttggaaaagctgaacaaaatgagtgaaaactctgtaccgccactctcatcggaactgaggtccagcatcttgggtctcccaggtgctatgggcgtcaggcacaggctgcccaaacactccattgttcttgacttcttcgggctctagccagactctccagagacaggtgtgtgcttggcctactctgccaaaaattcatggtgtaggacacagcaggtccttaagcactggtggcttgctccctttgctgtagtggagatgcttggcagatactcagtaggtagtcatgctaggtccaaggagagggccccagccattgtggaaagtagactgtgaggcaaaagtagcagtggcagtggcaccaaatcttggcttttcagatgggaatatcaagcagtggactcaggcttctcagaagcacttatatgaattttaaccctgttgcattgctttacgtaatcaatagaatgcaggctgctggtagagtgtagcttgacccattagcatgtaaatgggactgtgtgactgttgtcagttcaggtggtgaacagaaggctctgtgtccctggcagcttggaagtttcccgggggataggctaggaaatagaggaggagctaacctttggaggtgatggcaggcacctcacgggtcagtttgcaccacatttacaaacttacctgtgtctgtagacggatgaaactttgatggactcgctggcagcatgagacttgcagacctgtgtcttgatagatttgttgaaataatttttgtaggaatctcctctttggtaggtgctgttgctttggatgttgttgaagggatatccttggtatatttggaccttgttgtcatcctccttggcaaggtcaaagggaaagtctaggaacagttcttgcacttacagccttaggagaaccatcttggtgagggaccctctaaattagagaccaaggtgtcatgggacctttcttttcgatgttttggcctaactcttctggaaagacaagttgctagtgtgcataggaaggaggtttcaacagggcacattgtgttttgcaaatccaccttgagagccatgctcatgggaatcatcagggagaaaataagttcttggatgcagactgcatttgacacactaagataacttgagtcaagtcggatcctggcctgtgatagttctgcacaatgggattttcattagtgtgagaagctgagcagtatagcctgagaactttcaccagaagagaccaaagcaggggtggatggccaaaagcaatctcatgagagaggtggaagtcttcacaacagacaaaatgagcactggataggtagacagaaatagagactggctgccacagcaaggaatgtctcagggtaaaagacacacacacacacacacacacacacacacagacacacacacacacacacacactaacacagagagagggagagagaggggggttcctttcagctgtgaaaatgaagcctgcttcccatgacctggagttctgaactctcagaggagcttgattttacctcatgcaaagacacagaagtaatgatcagagaaggactggagccatgattgaaggctcaaaagttgttggcttagatatccttggaggcccaattttgctggtggagttattcagagctgcctcctccttctttgtcagcataggcaaggggacctatgattgcccttgttattggctttttctgactggatgcttggagaagagccttcattcccttgaaaactttgcacaggacactggtggaagaagttgatggcatggacctaagagaaagtgttgagtacctgtattgcagctcacatatcatccttaagtccttagagtgagctgaggacccagcaagcacttgagagcaaagggcatggcatgttcccatccaaggcctgagagtaacagcaagtgagatctggaggggcagtgtgaagaggttggtaagagcaggagtgttgagggtgcctgtgagatatgacaagcccatagtacatggtaagcccataatccatgtggttttgcattggtcccactgtaatcggggcatgttctctgtgttgtcttcacagggttgcattccctttccagtatgatccatagaaaacatgcagaggaaatggccccacagcattggctgagagtttatgtcgtccaactgagtctccatcgaactgttgtggtgttgctgacttgccctaggtcacctgagttaaatggtaaggaacatgggaattgctgcatgaattctaggtgcccaggtcttggtggagcagggaacggctgccattgattatgtccaggcccttcgggacatggagcatgcctagggcctctggtttctcccatgtttggagctttggcccattgttccctggcagtggattgtcagtgtccagcagtccattgctctccccaaagccagagcactccagagtactggaaccacttgatgcaatgcactccaacgagcttggatctatgatgattcccagtcaaacattccttggaaaagctgaacaaaatgagtgaaaactctgtaccgccactctcatcggaactgaggtccagcatcttgggtctcccagttgctatgggcatcaggcacaggctgcccaaccactccattgttcttgacttcttcgggctctagccagactctccagagacaggtgtgtgcttggcctactctgccaaaaatccatggcgtaggacacagcaggtccttaagctctggtggcttgctccctttgctgtagtggagatgcttggcagatactcagtggatagtcgtgctaggtccatggagagggccccagccattgtggaaagtagactgtgaggcaaaagtagcagtggcagtggcaccaaatcatggcttttcacatgggaatatcaagcagtggactccggcttcagaagcacttatatgaattttaaccctgttgcattgctttacgtaatcaatagaatgcaggctgctggtagagtgtagcttgacccattagcatataaacgggactgtgtgactgttgtcggttcaggtggtgaacagaaggctctgtgtcccaggcagcttggaagtttcccggggggttggctaggaaatagagaaggagctaagccttggaggtgatggcaggcacctcacgggtcagtttgcaccacatttacacacttacctgtgtttgtagacggatgaaactttgatggactcgctgggagcatgagacttgcagacctgtgtctcgatagatttgttgaaataatttttgaaggaatctcctctttggtaggtgctgttgctttggatgttgtggaagggatatccttggtatatttggaccttgttgtcagcctgcttggcaaggtcaaagggaaagtctaggaacagttcttgcacccacagccttaggagaaccatcttgttgagggaccctctaaattagagaccaaggtgtcatgggacctttcttttcgatgttttggcctaactcttctggaaagacaagttgctagtgtgcataggaaggaggtttcaacagggcacatcgtgttttgcaaatccaccttgagagccatgctcatgggaatcatcagggagaaaataagttcttggatgcagactgcatttgacacactaagataacttgagtcaagtcggatcctggcctgtgatagttctgcacaatgggattttcattagtgtgagaagctgagcagtatagtctgagaacttttcaccagaagagatcaaagcaggggtggatggccaaaagcaatctcatgagagaggtggaagtcttcacaacagacaaaatgagcactggacaggtggacagaaatagggactggctgccacagcaaggaatgtctcagggtaaaagacacacacacacacacacacacacacacacacacacacacacacacacacacacacagacacacacacacacacacactaacaaagagagagggagagagagggggttcctttcagctgtgaaaatgaagcctgcttccaatgagctggaattctgaactctcagaggagtttgattttacctcatgcaaagacccagaagtaatgatcagagaaggactggagccatgattgaaggctcaaaagttgttggcttagatatccttggaggcccaattttgctggtggagttattcagagctgcctcctccttttttgactgcataggcaaggggacctctgattgcccttgttattggttttttctgactggatgcttcgagaagagccttcattcccttgaaaactttgcttaggacactggtggaggaagttgatgacatggacctaagagaaagtgttgagtacctgtattgcagctcacatatcatccttaagtccttagagtgagctgaggaccaagcaagcacttgagagcaaagggcatggcatgttcacattcaaggcctgagagtaacagcaagtgagatctggaaaggcagtgtgaagaggttggtaagagcaggagtgttgagggtgcctgtgagatatgacaagcccatagtacatggtaagcccataatccatgtggttttgcattggtcccactgtaatcggggcatgttctctgtgttgtcttcacagggttgcattccctttccagtatggtccatggaaaacattcagaggaaatggccccacagcattggctgagtgtttatgtcgaccaacttagtctcgatcgacctgttgtggtgttgctgacttgccctaggtcacctgagttaaatggtaaggaacatgggaattgctgcatgaattctaggtgcccaggtcttggtggagcagggaacggctgccattgattatgtccaggcccttcgggacatggagcatgcctagggcctctggtttctcccatgtttggagcttcggcccattgttccctggcagtggattgtcagtgtccagaagtccattgctctccccaaagccagagcactccagagtacaggaaccacttgatgcaatgcactccaacgagcttggatctatgatgattcccagtcaaacattccttggaaaagctgaacaaaatgagtgaaaactctgtaccgccactctcatcggaactgaggtccagcatcttgggtctcccaggtgctatgggcgtcaggcacaggctgcccaaccactccattgttcttgacttcttcgggctctagccagactctccagagacaggtgtgtgcttggcctactctgccaaaaatccatggcgtaggacacagcaggtccttaagctctggtggcttgctccctttgctgtagtggagatgcttggcagatactcagtaggtagtcatgctaggtccaaggagagggccccagccattgtggaaagtagactgtgaggcaaaagtagcagtggcagtggcaccaaatcttggcttttcagatgggaatatcaagcagtggactcaggcttctcagaagcacttatatgaattttaaccctgttgcattgctttacgtagtcaatagaatgcaggctgctggtagagtgtagcttgacccagtagcatgtaaatgggactgtgtgactgttgtcatttcaggtggtgaacagaaggctctgtgtccctggcagcttggatgtttcccaggggggttgctaggaaatagagaaggagctaagccttggaggtgatggcaggcacctcacgggtcagtttgtaccacatttacacatttacctgtgtctgtagacggatgaaactttgatggactcgctggcagcatgagacttgcagacctgtgtctccatagatttgttgaaataatttttgtaggaatctcctctttggtaggtgctgttgctttggatgttgttgaagggatatccttggtatatttggacattgttgtcagcctccttggcaaggtcaaagggaaagtctaggaacagttcttgcacccacagccttaggagaaccatcttggtgagggaccctctaaattagagaccaaggtgtcatgggacctttcttttcgatgttttggcctaactcttctggaaagacacgttgctagtgtgcataggaaggaggtttcaacagggcacatcgtgttttgcaaatccaccttgagagccatgctcatgggaatcatcagggagaaaataagttcttggatgcagactgcatttgacacactaagataacttgagtcaagtcggatcctggcctgtgatagttctgcacaatgggattttcattagtgtgagaagctgagcagtatagtctgagaactttttaccagaagagatcaaagcaggggtggatggccaaaagcaatctcatgagagaggtggaagtcttcacaacagacaaaatgagcactggacaggtggacagaaatagggactggctgccacagcaaggaatgtctcagggtaaaagacacacacacacacacacacacacacactaacacagagagagggagagagaggggggttcctttcagctgtgaaaatgaagcctgcttcccatgagctggaattctgaactctcagaggagtttgattttacctcatgcaaagacccagaagtaatgatcagagaaggactggagccatgattgaaggctcaaaagttgttggcttagatatccttggaggcccaattttgctggtggagttattcagagctgcctcctcctttttcgactgcataggcaaggggacttatgattgcacttgttattggttttttctgactggatgcttggagagagccttcattcccttgaaaactttgctcaggacactggtggatgaagttgatggcatggatctaagagaaagtgttgagtacttgtattgcagctcacatatcatccttaagtccttagagtgagctgaggacccagcaagcacttgaaagcaaagggcatggcatgttcacatccaaggcctgagagtaacagcaagtgagatctggaagggcagtgtgaagaggttggtaagagcaggagtgttgagggtgcctgtgagatatgacaagcccatagtacatggtaatcccataatccatgtggtattgcattggtcccactgtaatcagggcatgttctttgtgttgtcttcacagggttgcattccctttccagtatggtccatggaaaacatgcagaggaaatggccccacagcattggctgagagtttatgtcgtccaactgagtctccatcgaactgttgtggtgttgctgacttgccctaggtcacctgagttaaatggtaaggaacatgggaattgctgcatgaattctaggtgcccaggtcttggtggagcagggaacggctgccattgattatgtccaggcccttcgggacatggagcaggcctagggcctctggtgtctcccatgtttggagcttcggcccattgttccctggcagtggattgtcagtgtccagcagtccattgctctccccaaagccagagcactccagagtactggaaccacttgatgcaatgcactccaacgagcttggatctatgatgattcccagtcaaacattccttggaaaagctgaacaaaatgagtgaaaactctgtaccgccactctcatcggaactgaggtccagcatcttgggtctcccaggtgctatgggcgtcaggcacaggctgcccaaccactccattgttcttgacttcttcgggctctagccagactctccagagacaggtgtgtgcttggcctactctgccaaaaatccatggtgtaggacacagcacgtccttaagctctggtggcttggtccctttgctgtagtggagatgcttggcagatactcagtaggtagtcgtgctaggtccaaggagagggccccagccattgtggaaagtagactgtgaggcaaaagtagcagtggcagtggcaccaaatcttggcttttcacatgggaatatcaagcagtggactcaggcttctcagaagcacttatatgaattttaaccctgttgcattgctttacgtagtcaatagaatgcaggctgctggtagagtgtagcttgacccagtaacatttaaacgggactgtgtgactcttgtcggttcaggtggtgaacagaaggctctgtgtccctggcagcttggaagtttcccgggcgattggctaggaaatagaggaggagctaacctttggaggtgatggcaggcacctcacgggtcagtttgcaccacatttacacacttacctgtgtctgtagacggatgaaactttgatggactcgctggcagcatgagacttgcagacctgtgtctcgatagatttgttgaaataactttggtaggaatctcctctttggtaggtgctgttgctttggatgttgtggaagggatatccttggtatatttggaccttgttgtcagcctgcttggcaaggtcaaagggaaagtctaggaacagttcttgcacccacagccttaggagaaccatcttggtgagggaccctctaaattagagaccaaggtgtcatgggacctttcttttcgatgttttggcctaactcttctggaaagacaagttgctagtgtgcataggaaggaggtttcaacagggcacattgtgttttgcaaatccaccttgagagccatgctcatgggaatcatcagggagaaaataagttcttggatgcagactgcatttgacacactaagataacttgagtcaagtcggatcctggcctgtgatagttctgcacaatgggattttcattagtgtgagaagctgagcagtatagcctgagaacttttcaccagaagagatcaaagcaggggtggatggccaaaagcaatctcatgagagaggtggaagtcttcacaacagacaaaatgagcactggacaggtggacagaaatagggactggctgccacagcaaggaatgtctcagggtaaaagacacacacacacacacacacacacacacacacacacacacacacacattaacacagagagagggagagagaggggggttcctttcagctgtgaaaatgaagcctgcttcccatgagctggaattctgaactctcagaggagtttgattttacctcatgcaaagtcccagaagcaatgatcagagaaggactggagccatgattgaaggctcaaaagttgttggcttagatatccttggaggcccaattttgctggtggagttattcaaagctgcctcctccttcttcgactgcataggcaaggggacctatgattgcccttgttattggctttttctgactgcatgcttggagaagagccttcattcccgtgaaaactatgctcaggacactggtggaggaagttgatggcaaagacctaagagaaagtgttgagtaccagtattgcagctcacatatcatccttaagtccttagagtgagctgaggacccagcaagcacttgagacaaagggcatggcatgttcacatccaaggcctgagagtaacagcaagtgagatctggaagggcagtgtgaagaggttggtaagagcaggagtgttgagggtgcctgtgagatatgacaagcccatagtacatggtaagcccataatccatgtggttttgcattggtcccactgtaatcagggcatgttctttgtgttgtcttcacagggttgcattccctttccagtatggtccatggaaaacatgcagaggaaatggccccacagcattggctgagtgtttatgtcgtccaactgagtctccatcgaactgttgtggtgttgctgacttgccctaggtcacctgagttaaatggtaaggcacatgggaattgctgcatgaattctaggtgcccaggtcttggtggagcagggaacagctgccattgattatgtccaggcccttcgggacatggagcatgcctagggcctctggtttctcccatgttttgagctttggcccattgttccctggcagtggattgtcagtgtccagcagtccattgctctccccaaagccagagcactccagagtactggaaccacttgatgcaatgcactccaacgagcttggatctatgatgattcccagtcaaacattccttggaaaagctgaacaaaatgagtgaaaactctgtaccgccactctcatcggaactgaggtccagcatcttgggtctcccaggtgctatgggcgtcaggcacaggctgcccaaacactccattgttcttgacttcttcgggctctagccagactctccagagacaggtgtgtgcttggcctactctgccaaaaattcatggtgtaggacacagcaggtccttaagcactggtggcttgctccctttgctgtagtggagatgcttggcagatactcagtaggtagtcatgctaggtccaaggagagggccccagccattgtggaaagtagactgtgaggcaaaagtagcagtggcagtggcaccaaatcttggcttttcagatgggaatatcaagcagtggactcaggcttctcagaagcacttatatgaattttaaccctgttgcattgctttacgtaatcaatagaatgcaggctgctggtagagtgtagcttgacccattagcatgtaaatgggactgtgtgactgttgtcagttcaggtggtgaacagaaggctctgtgtccctggcagcttggaagtttcccgggggataggctaggaaatagaggaggagctaacctttggaggtgatggcaggcacctcacgggtcagtttgcaccacatttacaaacttacctgtgtctgtagacggatgaaactttgatggactcgctggcagcatgagacttgcagacctgtgtcttgatagatttgttgaaataatttttgtaggaatctcctctttggtaggtgctgttgctttggatgttgttgaagggatatccttggtatatttggaccttgttgtcatcctccttggcaaggtcaaagggaaagtctaggaacagttcttgcacttacagccttaggagaaccatcttggtgagggaccctctaaattagagaccaaggtgtcatgggacctttcttttcgatgttttggcctaactcttctggaaagacaagttgctagtgtgcataggaaggaggtttcaacagggcacattgtgttttgcaaatccaccttgagagccatgctcatgggaatcatcagggagaaaataagttcttggatgcagactgcatttgacacactaagataacttgagtcaagtcggatcctggcctgtgatagttctgcacaatgggattttcattagtgtgagaagctgagcagtatagcctgagaactttcaccagaagagatcaaagcaggggtggatggccaaaagcaatctcatgagagaggtggaagtcttcacaacagacaaaatgagcactggataggtagacagaaatagagactggctgccacagcaaggaatgtctcagggtaaaagacacacacacacacacacacacacacacacacacacacacacacactaacacagagagagggagagagaggggggttcctttcagctgtgaaaatgaagcctgcttcccatgacctggagtctgaactctcagaggagcttgattttacctcatgcaaagacacagaagtaatgatcagagaaggactggagccatgattgaaggctcaaaagttgttggcttagatatccttggaggcccaattttgctggtggagttattcagagctgcctcctccttctttgtcaggataagcaaggggacctatgattgcccttgttattggctttttctgactggatgcttggagaagagccttcattcccttgaaaactttgctcaggacactggtggaagaagttgaatacatggacctaagagaaagtgttgagtacctgtattgcagctcacatatcatccttaagtccttagagtgagctgaggacccagcaagcacttgagacaaagggcatggcatgttcccatccaaggcctgagagtaacagcaagtgagatctggaggggcagtgtgaagaggttggtaagagcaggagtgttgagggtgcctgtgagatatgacaagcccatagtacatggtaagcccataatccatgtggttttgcattggtcccactgtaatcggggcatgttctctgtgttgtcttcacagggttgcattccctttccagtatgatccatagaaaacatgcagaggaaatggccccacagcattggctgagagtttatgtcgtccaactgagtctccatcgaactgttgtggtgttgctgacttgccctaggttacctgagttaaatggtaaggaacatgggaattgctgcatgaattctaggtgcccaggtcttggtggagcagggaacggctgccattgattatgtccaggcccttcaggacatggagcatgcctagggcctctggtttctcccatgtttggagctttggcccattgttccctggcagtggattgtcagtgtccagcagtccattgctctccccaaagccagagcactccagagtactggaaccacttgatgcaatgcactccaacgagcttggatctatgatgattcccagtcaaacattccttggaaaagctgaacaaaatgagtgaaaactctgtaccgccactctcatcggaactgaggtccagcatcttgggtctcccagttgctatgggcatcaggcacaggctgcccaaccactccattgttcttgacttcttcgggctctagccagactctccagagacaggtgtgtgcttggcctactctgccaaaaatccatggcgtaggacacagcaggtccttaagctctggtggcttgctccctttgctgtagtggagatgcttggcagatactcagtggatagtcgtgctaggtccatggagagggccccagccattgtggaaagtagactgtgaggcaaaagtagcagtggcagtggcaccaaatcatggcttttcacatgggaatatcaagcagtggactccggcttcagaagcacttatatgaattttaaccctgttgcattgctttacgtaatcaatagaatgcaggctgctggtagagtgtagcttgacccattagcatataaacgggactgtgtgactgttgtcggttcaggtggtgaacagaaggctctgtgtcccaggcagcttggaagtttcccggggggttggctaggaaatagagaaggagctaagccttggaggtgatggcaggcacctcacgggtcagtttgcaccacatttacacaccacctgtgtttgtagacggatgaaactttgatggactcgctgggagcatgagacttgcagacctgtgtctcgatagatttgttgaaataatttttgaaggaatctcctctttggtaggtgctgttgctttggatgttgtggaagggatatccttggtatatttggaccttgttgtcagcctgcttggcaaggtcaaagggaaagtctaggaacattttttgcacccacagccttaggagaaccatcttgttgagggaccctctaaattagagaccaaggtgtcatgggacctttcttttcgatgttttggcctaactcttctggaaagacaagttgctagtgtgcataggaaggaggtttcaacagggcacatcgtgttttgcaaatccaccttgagagccatgctcatgggaatcatcagggagaaaataagttcttggatgcagactgcatttgacacactaagataacttgagtcaagtcggatcctggcctgtgatagttctgcacaatgggattttcattagtgtgagaagctgagcagtatagtctgagaacttttcaccagaagagatcaaagcaggggtggatggccaaaagcaatctcatgagagaggtggaagtcttcacaacagacaaaatgagcactggacaggtggacagaaatagggactggctgccacagcaaggaatgtctcagggtaaaagacacacacacacacacacacacacacacacacacacacacacacacacacagacacacacacacacacacacactaacaaagagagagggagagagagggggttcctttcagctgtgaaaatgaagcctgcttccaatgagctggaattctgaactctcagaggagtttgattttacctcatgcaaagacccagaagtaatgatcagagaaggactggagccatgattgaaggctcaaaagttgttggcttagatatccttggaggcccaattttgctggtggagttattcagagctgcctcctccttttttgactgcataggcaaggggacctctgattgcccttgttattggttttttctgactggatgcttcgagaagagccttcattcccttgaaaactttgcttaggacactggtggaggaagttgatgacatggacctaagagaaagtgttgagtacctgtattgcagctcacatatcatccttaagtccttaaagtgagctgaggaccaagcaagcacttgagagcaaagggcatggcatgttcacattcaaggcctgagagtaacagcaagtgagatctggaaaggcagtgtgaagagtttggtaagagcaggagtgttgagggtgcctgtgagatatgacaagcccatagtacatggtaagcccataatccatgtggttttgcattggtcccactgtaatcggggcatgttctctgtgttgtcttcacagggttgcattccctttccagtatggtccatggaaaacattcagaggaaatggccccacagcattggctgagtgtttatgtcgaccaacttagtctcgatcgacctgttgtggtgttgctgacttgccctaggtcacctgagttaaatggtaaggaacatgggaattgctgcatgaattctaggtgcccaggtcttggtggagcagggaacggctgccattgattatgtccaggcccttcgggacatggagcatgcctagggcctctggtttctcccatgtttggagcttcggcccattgttccctggcagtggattgtcagtgtccagaagtccattgctctccccaaagccagagcactccagagtacaggaaccacttgatgcaatgcactccaacgagcttggatctatgatgattcccagtcaaacattccttggaaaagctgaacaaaatgagtgaaaactctgtaccgccactctcatcggaactgaggtccagcatcttgggtctcccaggtgctatggacgtcaggcacaggctgcccaaccactccattgttcttgacttcttcgggctctagccagactctccagagacaggtgtgtgcttggcctactctgccaaaaatccatggcgtaggacacagcaggtccttaagctctggtggcttgctccctttgctgtagtggagatgcttggcagatactcagtaggtagtcatgctaggtccaaggagagggccccagccattgtggaaagtagactgtgaggcaaaagtagcagtggcagtggcaccaaatcttggcttttcagatgggaatatcaagcagtggactcaggcttctcagaagcacttatatgaattttaaccctgttgcattgctttacgtagtcaatagaatgcaggctgctggtagagtgtagcttgacccagtagcatgtaaatgggactgtgtgactgttgtcatttcaggtggtgaacagaaggctctgtgtccctggcagcttggatgtttccccggggggttgctaggaaatagagaaggagctaagccttggaggtgatggcaggcacctcacgggtcagtttgtaccacatttacacatttacctgtgtctgtagacggatgaaactttgatggactcgctggcagcatgagacttgcagacctgtgtctccatagatttgttgaaataatttttgtaggaatctcctctttggtaggtgctgttgatgtggatgttgttgaagggatatccttggtatatttggacattgttgtcagcctccttggcaaggtcaaagggaaagtctaggaacagttcttgcacccacagccttaggagaaccatcttggcgagggaccctctaaattagagaccaaggtgtcatgggacctttcttttcgatgttttggcctaactcttctggaaagacaagttgctagtgtgcataggaaggaggtttcaacagggcacatcgtgttttgcaaatccaccttgagagccatgctcatgggaatcatcagggagaaaataagttcttggatgcagactgcatttgacacactaagataacttgagtcaagtcggatcctggcctgtgatagttctgcacaatgggattttcattagtgtgagaagctgagcagtatagtctgagaaattttaccagaagatatcaaagcaggggtggatggccaaaagcaatctcatgagagaggtggaagtcttcacaacagacaaaatgagcactggacaggtggacagaaatagggactggctgccacagcaaggaatgtctcagggtaaaagacacacacacacacacacacacacacacacacacactaacacagagagagggagagagaggggggttcctttcagctgtgaaaatgaagcctgcttcccatgagctggaattctgaactctcagaggagtttgattttacctcatgcaaaacccagaagtaatgatcagagaaggactggagccatgattgaaggctcaaaagttgttggcttagatatccttggaggcccaattttgctggtggagttattcagagctgcctcctcctttttcgactgcataggcaaggggacttatgattgcacttgttattggttttttctgactggatgcttggagagagccttcattcccttgaaaactttgctcaggacactggtggatgaagttgatggcatggatctaagagaaagtgttgagtacttgtattgcagctcacatatcatccttaagtccttagagtgagctgaggacccagcaagcacttgaaagcaaagggcatggcatgttcacatccaaggcctgagagtaacagcaagtgagatctggaagggcagtgtgaagaggttggtaagagcaggagtgttgagggtgcctgtgagatatgacaagcccatagtacatggtaagcccataatccatgtggtattgcattggtcccactgtaatcagggcatgttctttgtgttgtcttcacagggttgcattccctttccagtatggtccatggaaaacatgcagaggaaatggccccacagcattggctgagagtttatgtcgtccaactgagtctccattgaactgttgtggagttgctgacttgccctagggcacctgagttaaatggtaaggaacatgggaattgctgcatgaattctaggtgcccaggtcttggtggagcagggaacggctgccattgattatgtccaggcccttcgggacatggagcaggcctagggcctctggtgtctcccatgtttggagcttcggcccattgttccctggcagtggattgtcagtgtccagcagtccattgctctccccaaagccagagcactccagagtactggaaccacttgatgcaatgcactccaacgagcttggatctatgatgattcccagtcaaacattccttggaaaagctgaacaaaatgagtgaaaactctgtaccgccactctcatcgtaactgaggtccagcatcttgggtctcccaggtgctatgggcgtcaggcacaggctgcccaaccactccattgttcttgacttcttcgggctctagccagactctccagagacaggtgtgtgcttggcctactctgccaaaaatccatggtgtaggacacagcacgtccttaagctctggtggcttgctccctttgccgtagtggagatgcttggcagatactcagtaggtagtcatgctaggtccaaggagagggccccagccattgtggaaagtagactgtgaggcaaaagtagcagtggcagtggcaccaaatcttggcttttcacatgggaatatcaagcagtggactcaggcttctcagaagcacttatatgaattttaaccctgttgcattgctttacgtagtcaatagaatgcaggctgctggtagagtgtagcttgacccagtaacatttaaacgggactgtgtgactgttgtcggttcaggtggtgaacagaaggctctgtgtccctggcagcttggaagtttcccgggcgattggctaggaaatagaggaggagctaacctttggaggtgatggcaggcacctcacgggtcagtttgcaccacatttacacacttacctgtgtctgtagacggatgaaactttgacggactcgctggcagcatgagacttgcagacctgtgtctcgatagatttgttgaaataactttggtaggaatctcctctttggtaggtgctgttgctttggatgttgtggaagggatatccttggtatatttggaccttgttgtcagcctgcttggcaaggtcaaagggaaagtctaggaacagttcttgcacccacagccttaggagaaccatcttggtgagggaccctctaaattagagaccaaggtgtcatgggacctttcttttcgatgttttggcctaactcttctggaaagacaagttgctagtgtgcataggaaggaggtttcaacagggcacattgtgttttgcaaatccaccttgagagccatgctcatgggaatcatcagggagaaaataagttcttggatgcagactgcatttgacacactaagataacttgagtcaagtcggatcctggcctgtgatagttctgcacaatgggattttcattagtgtgagaagctgagcagtatagcctgagaacttttcaccagaagagatcaaagcaggggtggatggccaaaagcaatctcatgagagaggtggaagtcttcacaacagacaaaatgagcactggacaggtggacagaaatagggactggctgccacagcaaggaatgtctcagggtaaaagacacacacacacacacacacacacacacacacacacacacacacacacacattaacacagagagagggagagagaggggggttcctttcagctgtgaaaatgaagcctgcttcccatgagctggaattctgaactctcagaggagtttgattttacctcatgcaaagtcccagaagcaatgatcagagaaggactggagccatgattgaaggctcaaaagttgttggcttagatatccttggaggcccaattttgctggtggagttattcagagctgcctcctccttcttcgactgcataggcaaggggacctatgattgcccttgttattggctttttctgactgcatgcttggagaagagccttcattcccgtgaaaactatgctcaggacactggtggaggaagttgatggcaaagacctaagagaaagtgttgagtaccagtattgcagctcacatatcatccttaagtccttagagtgagctgaggacccagcaagcacttgagacaaagggcatggcatgttcacatccaaggcctgagagtaacagcaagtgagatctggaagggcagtgtgaagtggttggtaagagcaggagtgttgagggtgcctgtgagatatgacaagcccatagtacatggtaagcccataatccatgtggttttgcattggtcccactgtaatcagggcatgttctttgtgttgtcttcacagggttgcattccctttccagtatggtccatggaaaacatgcagaggaaatggccccacagcattggctgagtgtttatgtcgtccaactgagtctccatcgaactgttgtggtgttgctgacttgccctaggtcacctgagttaaatggtaaggcacatgggaattgctgcatgaattctaggtgcccaggtcttggtggagcagggaacagctgccattgattatgtccaggcccttcgggacatggagcatgcctagggcctctggtttctcccatgttttgagctttggcccattgttccctggcagtggattgtcagtgtccagcagtccattgctctccccaaagccagagcactccagagtactggaaccacttgatgcaatgcactccaacgagcttggatctatgatgattcccagtcaaacattccttggaaaagctgaacaaaatgagtgaaaactctgtaccgccactctcatcggaactgaggtccagcatcttgggtctcccaggtgctatgggcgtcaggcacaggctgcccaaccactccattgttcttgacttcttcgggctctagccagactctccagagacaggtgtgtgcttggcctactctgccaaaaattcatggtgtaggacacagcaggtccttaagcactggtggcttgctccctttgctgtagtggagatgcttggcagatactcagtaggtagtcgtgctaggtccaaggagagggccccagccattgtggaaagtagattgtgaggcaaaagtagcagtggcagtggcaccaaatcttggctattcacatgggaatatcaagcagtggagacaggcttctcagaagcacttatatgaattttaaccctgttgcattgcattacgtagtcaatagaatgcaggctgctggtagagtgtagcttgacccagtagcatgtaaacgggactgtgtgactgttgtcggttcaggtggtgaacagaaggctctgtgtccctggcagcttggaagtttcccgggcgattggctaggaaatagagaaggagctaagccttggaggtgatggcaggcacctcacgggtcagtttgcaccacatttacacacttacctgtgtctgtagacgaatgaaactttgatggactcgttggcagcatgagacttgcagacctgtgtctcgatagatttgttaaaataactttggtaggaatctcctctttggtaggtgctgttgctttggatgttgttgaagggatatccttggtatatttggaccttgttgtcagcctccttggcaaggtcaaagggaaagtctaggaacagttcttgcacccacagccttaggagaaccatcttggtgagggaccctctaaattagagaccaaggtgtcatgggacctttcttttcgatgttttggcctaactcttctggaaagacaagttgctagtgtgcataggaaggaggtttcaacagggcacattgtgttttgcaaatccaccttgagagccatgctcatgggaatcatcagggagaaaataagttcttggatgcagactgcatttgacacactaagataacttgagtcaagtcggatcctggcctgtgatagttctgcacaatgggattttcattagtgtgagaagctgagcagtatagcctgagaacttttcaccagaagagatcaaagcaggggtggatggccaaaagcaatctcatgagagaggtggaagtcttcacaacagacaaaatgagcactggacaggtggacagaaatagggactggctgccacagcaaggaatgtctcagggtaaaagacacacacacacacacacacacacacacacacacacacacacacacacacacacacacattaacacagagagagggagagagaggggggttcctttcagctgtgaaaatgaagcctgcttcccatgagctggaattctgaactctcagaggagtttgattttacctcatgcaaagtcccagaagcaatgatcagagaaggactggagccatgattgaaggctcaaaagttgttggcttagatatccttggaggcccaattttgctggtggagttattcagagctgcctcctccttcttcgactgcataggcaaggggacctatgattgcccttgttattggctttttctgactgcatgcttggagaagagccttcattcccgtgaaaactatgctcaggacactggtggaggaagttgatggcaaagacctaagagaaagtgttgagtaccagtattgcagctcacatatcatccttaagtccttagagtgagctgaggacccagcaagcacttgagacaaagggcatggcatgttcacatccaaggcctgagagtaacagcaagtgagatctggaagggcagtgtgaagaggttggtaagagcaggagtgttgagggtgcctgtgagatatgacaagcccatagtacatggtaagcccataatccatgtggttttgcattggtcccactgtaatcagggcatgttctttgtgttgtcttcacagggttgcattccctttccagtatggtccatggaaaacatgcagaggaaatggccccacagcattggctgagtgtttatgtcgtccaactgagtctccatcgaactgttgtggtgttgctgacttgccctaggtcacctgagttaaatggtaaggcacatgggaattgctgcatgaattctaggtgcccaggtcttggtggagcagggatcagctgccattgattatgtccaggcccttcgggacatggagcatgcctagggcctctggtttctcccatgttttgagctttggcccattgttccctggcagtggattgtcagtgtccagcagtccattgctctccccaaagccagagcactccagagtactggaaccacttgatgcaatgcactccaacgagcttggatctatgatgattcccagtcaaacattccttggaaaagctgaacaaaatgagtgaaaactctgtaccgccactctcatcggaactgaggtccagcatcttgggtctcccaggtgctatgggcgtcaggcacaggctgcccaaccactccattgttcttgacttcttcgggctctagccagactctccagagacaggtgtgtgcttggcctactctgccaaaaattcatggtgtaggacacagcaggtccttaagcactggtggcttgctccctttgctgtagtggagatgcttggcagatactcagtaggtagtcgtgctaggtccaaggagagggccccagccattgtggaaagtagattgtgaggcaaaagtagcagtggcagtggcaccaaatcttggctattcacatgggaatatcaagcagtggagacaggcttctcagaagcacttatatgaattttaaccctgttgcattgcattacgtagtcaatagaatgcaggctgctggtagagtgtagcttgacccagtagcatgtaaacgggactgtgtgactgttgtcggttcaggtggtgaacagaaggctctgtgtccctggcagcttggaagtttcccgggcgattggctaggaaatagagaaggagctaagccttggaggtgatggcaggcacctcacgggtcagtttgcaccacatttacacacttacctgtgtctgtagacggatgaaactttgatggactcgttggcagcatgagacttgcagacctgtgtctcgatagatttgttaaaataactttggtaggaatctcctctttggtaggtgctgttgctttggatgttgttgaagggatatccttggtatatttggaccttgttgtcagcctccttggcaaggtcaaagggaaagtctaggaacagttcttgcacccacagccttaggagaaccatcttggtgagggaccctctaaattagagaccaaggtgtcatgggacctttcttttcgatgttttggcctaactcttctggaaagacaagttgctagtgtgcataggaaggaggtttcaacagggcacattgtgttttgcaaatccaccttgagagccatgctcatgggaatcatcagggagaaaataagttcttggatgcagactgcatttgacacactaagataacttgagtcaagtcggatcctggcctgtgatagttctgcacaatgggattttcattagtgtgagaagctgagcagtatagcctgagaacttttcaccagaagagatcaaagcaggggtggatggccaaaagcaatctcatgagagaggtggaagtcttcacaacagacaaaatgagcactggacaggtggacagaaatagggactggctgccacagcaaggaatgtctcagggtaaaagacacacacacacacacacacacacacacacacacacacacacacacacacacacacacacacacattaacacagagagagggagagagaggggggttcctttcagctgtgaaaatgaagcctgcttcccatgagctggaattctgaactctcagaggagtttgattttacctcatgcaaagtcccagaagcaatgatcagagaaggactggagccatgattgaaggctcaaaagttgttggcttagatatccttggaggcccaattttgctggtggagttattcagagctgcctcctccttcttcgactgcataggcaaggggacctatgattgcccttgttattggctttttctgactgcatgcttggagaagagccttcattcccgtgaaaactatgctcaggacactggtggaggaagttgatggcaaagacctaagagaaagtgttgagtaccagtattgcagctcacatatcatccttaagtccttagagtgagctgaggacccagcaagcacttgagacaaagggcatggcatgttcacatccaaggcctgagagtaacagcaagtgagatctggaagggcagtgtgaagaggttggtaagagcaggagtgttgagggtgcctgtgagatatgacaagcccatagtacatggtaagcccataatccatgtggttttgcattggtcccactgtaatcagggcatgttctttgtgttgtcttcacagggttgcattccctttccagaatggtccatggaaaacatgcagaggaaatggccccacagcattggctgagtgtttatgtcgtccaactgagtctccatcgaactgttgtggtgttgctgacttgccctaggtcacctgagttaaatggtaaggaacatgggaattgctgcatgaattctaggtgcccaggtcttggtggagcagggaacagctgccattgattatgtccaggcccttcgggacatggagcatgcctagggcctctggtttctcccatgttttgagctttggcccattgttccctggcagtggattgtcagtgtccagcagtccattgctctccccaaagccagagcactccagagtactggaaccacttgatgcaatgcactccaacgagcttggatctatgatgattcccagtcaaacattccttggaaaagctgaacaaaatgagtggaaactctgtaccgccactctcatcggaactgaggtccagcatcttgggtctcccaggtgctatgggcgtcaggcacaggctgcccaaccactccattgttcttgacttcttcgggctctagccagactctccagagacaggtgtgtgcttggcctactctgccaaaaattcatggtgtaggacacagcaggtccttaagcactggtggcttgctccctttgctgtagtggagatgcttggcagatactcagtaggtagtcgtgctaggtccaaggagagggccccagccattgtggaaagtagattgtgaggcaaaagtagcagtggcagtggcaccaaatcttggctattcacatgggaatatcaagcagtggagacaggcttctcagaagcacttatatgaattttaaccctgttgcattgcattacgtagtcaatagaatgcaggctgctggtagagtgtagcttgacccagtagcatgtaaacgggactgtgtgactgttgtcggttcaggtggtgaacagaaggctctgtgtccctggcagcttggaagtttcccgggcgattggctaggaaatagagaaggagcaaagccttggaggtgatggcaggcacctcacgggtcagtttgcaccacatttacacacttacctgtgtctgtagacggatgaaactttgatggactcgctggcagcatgagacttgcagacctgtgtctcgatagatttgttaaaataactttggtaggaatctcctctttggtaggtgctgttgctttggatgttgttgaagggatatccttggtatatttggaccttgttgtcagcctccttggcaaggtcaaagggaaagtctaggaacagttcttgcacccacagccttaggagaaccatcttggtgagggaccctctaaattagagaccaaggtgtcatgggacctttcttttcgatgttttggcctaactcttctggaaagacaagttgctagtgtgcataggaaggaggtttcaacagggcacatcgtgttttgcaaatccattttgagagccatgctcatgggaatcatcagggagaaaataagttcttggatgcagactgcatttgacacactaagataacttgagtcaagtcggatcctggcctgtgatagttctgcacaatgggattttcattagtgtgagaagctgagcagtatagtctgagaacttttcaccagaagagatcaaagcaggggtggatggccaaaagcaatctcatgagagaggtggaagtcttcacaacagacaaaatgagcactggacaggtggacagaaatagggactggctgccacagcaaggaatgtctcagggtaaaagacacacacacacacacacacacacacactaacacagagagagggagagagagggggttcctttcagctgtgaaaatgaagcctgcttcccatgagctggaattctgaactctcagaggagtttgattttacctcatgcaaagacccagaagtaatgatcagagaaggactggagccatgattgaaggctcaaaagttgttggcttagatatccttggaggcccaatattgctggtggagttattcagagctgcctcctccttcttcgactgcataggcaaggggacctataattgcccgtgttattggctttttctgactgcatgcttggagaagagcctccattcccttgaaaactatgctcaggacactggtggaggaagttgatggcaaagacctaagagaaagtgttgagtacctgtattgcagctcacatatcatccttaagtccttagagtgagctcaggacccagcaagcacttgagacaaagggcatggcatgttcacatccaaggcctgagagtaacagcaagtgagatctggaagagcagtgtgaagaggttggtaagagcaggagtgttgagggtgcctgtgagatatgacaagcccatagtacatggtaagcccataatccatgtggttttgcattggtcccactgtaatcggggcatgttctctgtgttgtcttcacagggttgcattccctttccagtatgatccatagaaaacatgcagaggaaatggccccacagcattggctgagagtttatgtcgtccaaccgagtctccatcgaactgttgtggtgttgctgactggccctaggttacctgagttaaatggtaaggaacatgggaattgctgcatgaattctaggtgcccaggtcttggtggagcagggaacggctgccattgattatgtccaggcccttcgggacatggagcatgcctagggcctctggtttctcccatgtttggagcttcggcccattgttccctggcagtggattgtcagtgtccagcagtccatttctctccccaaagccagagcaatccagagtactggaaccacttgatgcaatgcactccaacgagcttggatctatgatgattcccagtcaaacattccttggaaaagctgaacaaaatgagtgaaaactctgtaccgccactctcatcggaactgaggtccagcatcttgggtctcccaggtgctatgggcgtcaggcacaggctgcccaaccactccattgttcttgacttcttctggctctagccagactctccagagacaggtgtgtgcttggcctactctgccaaaaatccatggcgtaggacacagcaggtccttaagctctggtggcttgctccctttgctgtagtggagatgcttggcagatactcagtggatagtcatgctaggtccaaggagagggccccagccattgtggaaagtagactgtgaggcaaaagtagcagtggcagtggcaccataacatggcttttcacaggggaatatcaagcagtggactccggcttctcagaagcacttatatgaattttaaccctgttgcattgctttacataatcaatagaatgcaggctgctggtagagtgtagcttgacccattagcatgtaaatgggactgtgtgactgttgtcagttcagttggtgaacagaaagctctgtgtccctggcagcttggaagtttcccgggggataggctaggaaatagagaaggagctaagtcttggaagtgatggcaggcacctcacgggtcagtttgcaccacatttacacacttacctgtgtctgtagaccgatgaaactttgatggactcgctggcagcatgagacttgcagacctgtgtctccatagatttgttgaaataatttttgaaggaatctcctctttggtaggtgctgttgctttggatgttgtggaagggatatccttggtatatttggaccttgttgtcagcctgcttggcaaggtcaaagggaaagtctaggaacagttcttgcacttacagccttaggagaaccatcttggtgagggaccctctaaattagagaccaaggtgtcatgggacctttcttttcgatgttttggcctaactcttctggaaagacaagttgctagtgtgcataggaaggaggtttcaacagggcacatcgtgttttgcaaatccaccttgagagccatgctcatgggaatcatcagggagaaaataagttcttggatgcagactgcatttgacacactaagataacttgagtcaagtcggatcctggcctgtgatagttctgcacaatgggattttcattagtgtgagaagctgagcagtatagcctgagaacttttcaccagaagagatcaaagcaggggtggatggccaaaagcaatctcatgagagaggtggaagtcttcacaacagacaaaatgagcactggataggtagacagaaatagagcctggctgccacagcaaggaatgtctcagggtaaaagacacacacacacacacacacacacacacacacacacactaacacagagagagggagagagaggggggttcctttcagctgtgaaaatgaagcctgcttcccatgacctggagttctgaactctcagaggagcttgattttacctcatgcaaagacccagaagtaatgatcagagaaggactggagccatgattgaaggctcaaaagttgttggcttagatatccttggaggcccaatattgctggtggagttattcagagctgcctccttcttcgtcagcataggcaaggggacctatgattgcccttgttattggctttttctgactggatgcttggagaagagccttcattcccttgaaactttgctcaggacactggtggaagaagttgatggcatggacctaagagaaagtgttgagtacctgtattgcagctcacatatcatccttaagtccttagagtgagctgaggacccagcaagcacttgagagcaaagggcatggcatgttcacatccaaggcctgagagtaacagcaagtgagatctggaagggcagtgtgaagaggttggtaagagcaggagtgttgagggtgcctgtgagatatgacaagcccatagtacatggtaagcccataatccatgtggttttgcattggtcccactgtaatcggggcatgttctttgtgttgtcttcacagggttgcattccctttccagtatggtccatggaaaacatgcagaggaaatggccccacagcattggctgagtgtttatgtcgtccaactgagtctccatcgaactgttgtggtgttgctgacttgccctaggtcacctgagttaaatggtaaggaacatgggaattgctgcatgaattctaggtgcccaggtcttggtggagcaggtaacggctgccattgaatatgtccaggcccttcgggacatggagcatgcctagggcctctggtttctcccatgtttggagcttcggcccattgttccctggcagtggattgtcagtgtccagcagtccattgctctccccaaagccagagcactccagagtcctggaaccacttgatgcaatgcactccaacgagcttggatctatgatgattcccagtcaaacattccttggaaaagctgaacaaaatgagtgaaaactctgtaccgccactctcatcggaactgaggtccagcatcttgggtctcccaggtgctatgggcgtcaggcacaggctgcccaaccactccattgttcttgacttcttcgggctctagccagactctccagagccaggtgtgtgcttggcctactctgccaaaattccatggtgtaggacacagcacgtccttaagctctggtggcttgctccctttgctgtagtggagatccttggcagatactcagtaggtagtcgtgctaggtccaagaagagggccccagccattgtggaaagtagactgtgaggcaaaagaagcagtggcagtggcaccaaatcttggcttttcacatgggaatatcaagcagtggactcaggcttctcagaagcacttatatgaattttaaccctgttgcattgctttacgtagtcaatagaatgcaggctgctggtagagtgtagcttgacccagtaacatttaaacgggactgtgtgactgttgtcggttcaggtggtgaacagaaggctctgtgtcccttgcagcttggaagttcccgggggattggctaggaaatagaggaggagctaacctttggaggtgatggcaggcacctcacgggtcagtttgcaccacatttacacacttacctgtgtctgtagacggatgaaactttgatggactcgctgggagcatgagacttgcagacctgtgtctcaatagatttgttgaaataactttggtaggaatgtcctctttggtaggtgctgttgctttggatgttgttgaagggatatccttggtatatttggaccttgttgtcagcctccttggcaaggtcaaagggaaagtctagaaacagtttttgcacccacagccttaggagaaccatcttggtgagggaccctctaaattagagaccaaggtgtcaggggacctttcttttcgatgttttggcctaactcttctggaaagacaagttgctagtgtgcataggaaggaggtttcaacagggcacatcgtgttttgcaaatccaccttgagagccatgctcatgggaatcatcagggagaaaataagttcttggatgcagactgcatttgacacactaagataacttgagtcaagtcggatcctggcctgtgatagttctgcacaatgggattttcattagtgtgagaagctgagcagtatagcctgagaacttttcaccagaagagatcaaagcaggggtggatggccaaaagcaatctcatgagagaggtggaagtcttcacaacagacaaaatgagcactggataggtagacacgaaatagagactggctgccacagcaaggaatgtctcagggtaaaagacacacacacacacacacacacacacacacacacacacacacacacacacacacacaaacactaacacagagagagggagagagagggggtttcctttcagctgtgaaaatgaagcctgcttcccatgacctggagttctgaactctcagaggagcttgattttacctcatgcaaagacccagaagtaatgatcagagaaggactggagccatgattgaaggctcaaaagttgttggcttagatatgcttggaggcccaattttgctggtggagttattcagagctgcctcctccttcttcgactgcataggcaaggggacctatgattgcccttgttattggctttttctgactgcatgcttggagaagagccttcattcccgtgaaaactatgctcaggacactggtggaggaagttgatggcaaagacctaagagaaagtgttgagtaccagtattgcagctcacatatcatccttaagtccttagagtgagctgaggacccagcaagcacttgagacaaagggcatggcatgttcacatccaaggcctgagagtaacagcaagtgagatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattctgaactctcagaggagtttgattttacctcatgcaaagacccggaattaatgatcagagaaggactggagccatgattgaaggctcaaaagttgttggcttagatatctttggagacccaattttgctggtggacttattcagagctgcctcctccttcttcatcagcatagccaagaggacctatgattgcgcttgttattggatttttctgactggatgcttggagaagagccttcattcccttgaaaactttgctcaggacactggtggaggaagttgatggcatggacctaagagaaagtgttgagtacctgtattgcagctcacatatcatccttaagtccttagagtgagctgaggacccagcaagcacttgagagcaaagggcatggcatgttcacatccaaggcccgagagtaacagcaagtgagatctggaagggcagtgtgaaggggttggtaagagcaggagtgtagagggtgcctgtgagatatgacaagcccatagtacatggtaagcccataatccatgcggattttcattggtcccactgtaatcggggcatgatctctgtgctgtcttcacagggttgcattccctttccagtatggtccatggaaaacatgcagaggaaatggccccacagcattggctgagtgtttatgtcgtccaaccgagtctccatcgaactgttgtggtgttgctgacttgccctaggtcacctgagttaaaaggtaaggaacatgggaattgctgcatgaattctaggtgctcaggtcttggtggagcagggaacggctgccattgaatgtgtccaggcccttcgggacatggagcatgcctagggcctctggtttctcccatgtttggagcttcggcccattgttccctggcagtggattgtcagtctccagcagtccattgctctacccaaagccagaacactccagagtactggaaccacttgatgcaatgcactccaacgtgcttggatctatgatgattcccagtcaaacattccttggaaaagctgaacaaaatgagtgaaaactctgtaccgccactctcatcggaactgaggtccagcatcttgggtctcccaggtgctatgggcgtcaggcacaggctgcccaaccactccatttttcttgacttcttcgggctctagccagactctccagagacaggtgtgtgcttggcctaccctgccaaaaatccatggcataggacacagcaggtccttaagctatggtggcttgctccctttgctgtagtggagatgcttggcagatactcagtaggtagtcttgctaggtccaaggagagggccccagacattgtggaaagtagagtgtgaggcaaaattgcagtggcagtggcaccaaatcttggcttttcacatgggaatatcaagcagtggactcaggcttctcagaagcacttatatgaattttaaccctgttgcattgctttatggagttaatagaatgcaggctgctggtagagtgtagcttgacccagtagcatgtaaacgggactgtgtgactgttgtctgttcaggtggtgaacagaaggctctgtgtccctggcaccatggaagtttcccgggtgattggcttggaaatatagaaggagctaagccttggaggtgatgacagtcacctcacgggtcagttttcaccacatttacacacttacctgtgtctgcagacagtgaaactttgatggacaagctgggtgcatgagacttgcagacctgtgtctcgatagatttgttgaaataacttttgtaggaatctcccctttggtaggtgctgttgctttggatgttgttgaagggatatccttggtatatttggatattgttgtcagcctccttggcaaggtaaaagggaaagtctaggaacagttcttgcacccacagccttaagagaaccatcttggtgagggaccctctaaattagagaccaaggtgtcatgggacctttcttttcgatgttttggcctaactcttatggaaagacaagttgctagtgtgcataggaaggaggtttcaacagggcacatggtgttttgcaaatccaccttgagagccatgctcattagaatcatcagggagaaaataagttcttgaatgcagactgcatttgacacactaagataacttgagtcaagttggatcctggcctgtgatagttctgcaaaatgggattttcattagtgtgagaaggtgaacagtatagtctgagaagttttgaccagaagagatcaaagcagggatggatggcaaaaagcaatctcatgacaaggtggaagtcttcacaacagacaaaatgagcactggacaggtggacataaatagggatggctgccacagcaaggaatgtctcagggtaaaagacacacactcacaccacacacacacacacacacacacacacacactaacacagagagaaagagagagagggggggttcctttaagctgtgaaaatgaagcctgcttcccatgagctggaattttgaaccctcagaggagtttgattttacctcatgcaaagacccagaagtaatgatcagagaaggactggagccatgattgaaggctcaaaagttgttggcttagatatccatggaggcccaattttgctggagggcttattcagagctgcctcctccttcttcgtcagcataggcaaggggacctatgattgcccttggtataggcttcttctgactggatgcttggagaagagccttcattcctttgaaaactttgctcaggacactggtggaggaagttgatggcatggacctaagagaaagtgttgagtacctgtattgcagctcacatatcatccttaagtccttagagtgagctgaggacccagcaagcacttgagagcaaagggcatggcatgttcacatccaaggcctgggagtaacagcaagtgagatctggaagggcagtgtgaagaggttggtaagagcagttgtgttgagggtgcctgtgagatatgacaagcccatagtacatggtaagcccataatccatgtggttttgcattggtcccactgtaatcggggcattttttccgtgctgtcttcacagggttgcattccctttccagcatggtccatggaaaacatgcagaggaaatggcctcacagcattggctgagtgtttatgtcgtccaaccgagtctccatcgaacttttctggtgttgctgacttgccctaggtcacctgagttaaaaggtaaggaacatgggaattgctgcatgaattctaggtgcccaggtcttggtggagcagggaacggctgccattgatatgtacaggcccttcgggacctggaacatgcctggggcctcatatttctcccaggtttggagcttcggcccattgttccctggcagtggattgtcagtgtccagcagtccattgctctacccaaagccagagcactccagagtactggaaccacttgatgcaatgcactgcaacgtgcttggatctatgatgattcccagtcaaacattccttggaaaagctgaacaaaatgagtgaaaactctgtaccgccactgtcattggaactgaggtccagcatcttgggtctcccaggtgctatgggcgtcaggcacaggctgcccaatgttgggagccgcgcccacattcgccgttacaagatggcgctgacagctgtgttctaagtggtaaacaaataatctgcgcatgtgccgagggtggttcttcactccatgtgctctgccttccccgtgacgtcaactcggccgatgggctgcagccaatcagggagtgacacgtccgaggcgaaggataattctcctaaaaaagggacggggtttcgttttctctctctcttgcttcttacgctcttgcttcttgcactctggctcctgaagatgtaagcaataaagctttgccgcagaagattctggtctgtggtgttcttcctggccggttgtgagaacgcgtctaataacaattggtgccgaattccgggacgagaaaaaaactcgggactggcgcaaggaagatccctcattccagaaccagaactgcgggtcgcggtaataaaggttcccgtaaaacagactgttaagaaggattcaactgtatgaattcagaacttttcagctggggaacgagagtaccagtgagtacagctttacgaggtaagtctgatcttgaactttctaaggaaattcaagacagtctatcagaagtaaagtggaatatgtttggccttgaattttttctaatgttaggagcccttttgttccttttcacatgttatcaagtggttaagatagggcggattctagatgaaattcaggacaagctatcagaagtaaagcggggagagagagtaggagcaaagagaaaatatggtacacaaaataagtatacaggcctttccaagggtcttgaacccgaggaaaagttaaggttaggtaggaatacctggagagagattagaagaaaaagaggaaaaagggaaaagaagaaagatcaattagcggaggtctctaggagatactcgtcactagatgagctcaggaagccagctcttagtagttctgaagcagatgaagaattctcctctgaggaaacagactgggaggaagaagcagcccattaccagccagctaattggtcaagaaaaaagccaaaagcggctggcgaaggccagtttgctgattggcctcagggcagtcggcttcaaggtccgccctatgcggagtccccgccctgcgtagtgcgtcagcaatgcgcagagaggcagtgcgcagagaggcagtgcgcagactcattcattcccagagaggaacaaaggaaaatacaacaggcatttccggtctttgaaggagccgagggtgggcgtgtccacgctccggtagaatacttacaaattaaagaaattgccgagtcggtccgtaaatatggaaccaatgctaattttaccttggtgcagttagacaggctcgccggcatggcactaactcctgccgactggcaaacggttgtaaaagccgctctccctagtatgggcaaatatatggaatggagagctctttggcatgaaactgcacaagcgcaggcccgagcaaacgcagctgctttgactccagagcagagagattggacttttgacttgttaacgggtcagggagcttattctgctgatcagacaaactaccattggggagcttatgcccagatttcttccacggctattagggcctggaaggcgctctctcgagcaggtgaaaccactggtcagttaacaaagataatccagggacctcaggaatccttctcagattttgtggccagaatgacagaggcagcagagcgtatttttggagagtcagagcaagctgcgcctctgatagaacagctaatctatgagcaagccacaaaggagtgccgagcggccatagccccaagaaagaacaaaggcttacaagactggctcagggtctgtcgagagcttgggggacctctcagcaatgcaggtttagcggctgccatccttcaatcccaaaaccgctccatgagcagaaatgatcagaggacatgttttaactgcggaaagcctgggcattttaagaaagattgcagagctccagataaacagggagggactctcactctttgctctaagtgtggcaagggttatcatagagctgaccagtgtcgctctgtgagggatataaagggcagaattcttcccccacctgatagtcaatcagcttatgtgccaaaaaacgggtcatcgggccctcggtcccagggccctcaaagatatgggaaccggtttgtcaggacccaggaagcagtcagagaggcgacccaggaagacccacaagggtggacctgcgtgccgcctccgacttcctattaatgcctcaaatgagtattcagccggtgccagtggagcctataccatccttgcccccgggaaccatgggccttattctcggccggggttcactcaccttacagggcttagtagtccaccctggagttatggattgtcaacattcccctgaaatacaggtcctgtgctcaagccctaaaggcgttttttctattagtaaaggagataggatagctcagctgctgctcctccctgataataccagggaaaaatctgcaggacctgagataaagaaaatgggctcctcaggaaatgattctgcctatttggttgtatctttaaatgatagacctaagctccgccttaagatcaacggaaaagagtttgaaggcatccttgataccggagcagataaaagtataatttctacacattggtggcccaaagcatggcccaccacagagtcatctcattcattacagggcctaggatatcaatcatgtcccactataagctccgttgccttgacgtgggaatcctctgaaggacagcaagggaaattcataccttatgtgctcccactcccggttaacctctggggaagggatattatgcagcatttgggccttattttgtccaatgaaaacgccccatcaggagggtattcaactaaagcaaaaaatatcatggcaaagatgggttataaagaaggaaaagggttaggacatcaagaacagggaaggatagagcccatctcacctaatggaaaccaagacagacagggtctgggttttccttagcggccattggggcagcacgacccataccatggaaaacaggggacccagtgtgggttcctcaatggcacctatcctctgaaaaactagaagctgtgattcaactggtagaggaacaattaaaactaggccatattgagccatctacctcaccttggaatactccaatttttgtaattaagaaaaagtcaggaaagtggagactgctccatgacctcagagccattaatgagcaaatgaacttatttggcccagtacagaggggtctccctgtactttccgccttaccacgtggctggaatttaattattatagatattaaagattgtttcttttctatacctttgtgtccaagagataggcccagatttgcctttaccatcccctctattaatcacatggaacctgataagaggtatcaatggaaggtcttaccacagggaatgtccaatagtcctacaatgtgccaactttatgtgcaagaagctcttttgccagtgagggaacaattcccctctttaattttgctcctttacatggatgacatcctcctgtgccataaagaccttaccatgctacaaaaggcatatccttttctacttaaaactttaagtcagtggggtttacagatagccacagaaaaggtccaaatttctgatacaggacaattcttgggctctgtggtgtccccagataagattgtgccccaaaaggtagagataagaagagatcacctccataccttaaatgattttcaaaagctgttgggagatattaattggcttagaccttttttaaagattccttccgctgagttaaggcctttgtttagtattttagaaggagatcctcatatctcctcccctaggactcttactctagctgctaaccaggccttacaaaaggtggaaaaagccttacagaatgcacaattacaacgtattgaggattcgcaacctttcagtttgtgtgtctttaagacagcacaattgccaactgcagttttgtggcagaatgggccattgttgtggatccatccaaacgtatccccagctaaaataatagattggtatcctgatgcaattgcacagcttgcccttaaaggtctaaaagcagcaatcacccactttgggcaaagtccatatcttttaattgtaccttataccgctgcacaggttcaaaccttggcagccacatctaatgattgggcagttttagttacctccttttcaggaaaaatagataaccattatccaaaacatccaatcttacagtttgcccaaaatcaatctgttgtgtttccacaaataacagtaagaaacccacttaaaaatgggattgtggtatatactgatggatcaaaaactggcataggtgcctatgtggctaatggtaaagtggtatccaaacaatataatgaaaattcacctcaagtggtagaatgtttagtggttttagaagttttaaaaacctttttagaaccccttaatattgtgtcagattcctgttatgtggttaatgcagtaaatcttttagaagtggctggagtgattaagccttccagtagagttgccaatatttttcagcagatacaattagttttgttatctagaagatctcctgtttatattactcatgttagagcccattcaggcctacctggccccatggctctgggaaatgatttggcagataaggccactaaagtggtggctgctgccctatcatccccggtagaggctgcaagaaattttcataacaattttcatgtgacggctgaaacattacgcagtcgtttctccttgacaagaaaagaagcccgtgacattgttactcaatgtcaaagctgctgtgagttcttgccagttcctcatgtgggaattaacccacgcggtattcgacctctacaggtctggcaaatggatgttacacatgtttcttcctttggaaaacttcaatatctccatgtgtccattgacacatgttctggcatcatgtttgcttctccgttaaccggagaaaaagcctcacatgtgattcaacattgccttgaggcatggagtgcttgggggaaacccagactccttaagactgataatggaccagcttatacgtctcaaaaattccaacagttctgccgtcagatggacgtgacccacctgactggacttccatacaaccctcaaggacagggtattgttgagcgtgcgcatcgcaccctcaaagcctatcttataaaacagaagaggggaacttttgaggagactgtaccccgagcaccaagagtgtctgtgtctatggcactctttacactcaattttttaaatattgatgttcatggccatactgcggctgaacgtcattgtacagagccagataggcccaatgagatggttaaatggaaaaatgtccttgataataaatggtatggcccggatcctattttgataagatccaggggagctatctgtgttttcccacagaatgaagacaacccattttggttaccagaaagactcacccgaaaaatccagactgaccaagggaatactaatgtccctcgtcttggtgatgtccagggcgtcaataataaagagagagcagcgttgggggataatgtcgacatttccactcccaatgacggtgatgtataatgctcaagtattctcctgcttttttaccactaactgggaactgggtttggccttgattcagacagccttggctctgtctggacaggtccagacgactgacaccattaacactttgtcagcctcagtgactacagtcatagataaacaggcctcagctaatgtcaagatacagagaggtctcatgctggttaatcaactcatagatcttgtccagatacaactagatgtattatgacaaataactcagcagggatgtgaacaaaagtttccgggattgtgtgttatttccattcagtatgttaaatttactagggcagctaatttgtcaaaaagtctttttcagtatatgttacagaattggatggctgaatttgaacagatccttcgggaattgagacttcaggtcaactccacgcgcttggacctgtccctgaccaaaggattacccaattggatctcctcagcattttctttctttaaaaaattgggtgggattaatattatttggagatacactttgctgtggattagtgttgcttctttgattggtctgtaagcttaaggcccaaactaggagagacaaggtggttattgcccaggcgcttgcagctctagaacatggtgctccccctgatatatggttatctatgcttaggcaataggtcgctggccactcagctcttatatcccacgaggctagtctcattgcacgggatagagtgagtgtgcttcagcagcccgagagagttgcacggctaagcactgcaatggaaaggctctgcggcatatatgagcctattctagggagacatgtcatctttcatgaaggttcagtgtcctagttcccttcccccaggcaaaacgacacgggagcaggtcagggttgctctgggtaaaagcctgtgagcctaagagctaatcctgtacatggctcctttacctacacactggggatttgacctctatctccactctcattaatatgggtggcctatttgctcttattaaaaggaaagggggagatgttgggagccacgcccacattcgccgttacaagatggcgctgacagctgtgttctaagtggtaaacaaataatctgcgcatgtgccgagggtggttcttcactccatgtgctctgccttccccgtgacgtcaactcggccgatgggctgcagccaatcagggagtgacacgtccgaggcgaaggataattctcctaaaaaagggacggggtttcgttttctctctctcttgcttcttacgctcttgcttcttgcactctggctcctgaagatgtaagcaataaagctttgccgcagaagattctggtctgtggtgttcttcctggccggtcgtgagaacgcgtctaataacagcccaacaactccattgttcttgacttcttcgggctctagccagactctccaaagacaggtgtgtgcttggcctactctgccaaaaatccatggcgtaggacacagcaggtccttaagctctggtggcttgctccctttgctgtagtggagatgcttggcagattctcagtaggtagtcttgctaggtccaaggagagggccccagccattgtgaaaattagactgtgaggcaaaagtagcggtggcagtggcaccaaatcttggcttttcacatgggaatatcaagcagtggactcaggcttctcagaagcacttatatgaattttaaccctgttgcattgctttatgtagtcaatagaatgcacgctgctggtagagtgtagcttgacccagtagcatgtaaacgggactgtgtgactgttgtctgttcaggtggtgaacagaaggctctgtgtccctggcagcttggaagtttcccgggtgattggcttggaaataagaaggagctaagccttggaggtgatggcaggcacctcacgggtcagtttgcaccacatttacacacttacctgtgtctgtagattgatgaaactttgatggactcgctggaagcatgagacttgcagacctgtgtctcgatagatttgttgaaataacttttgtaggaatctccactttggtaggtgctgttgctttggatgttgttgaagggatatcctgggtatatttggatattgttgtcagcctccttgtcaaggtcaaagggaaagtctaggaacagttcttgcacacacagcctaaggagaaccatcttggtgagggacactctaaattagagaccaaggtgtcatgggacctttcttttcgatgttttggccttactcctctggaaagacaagttgctagtgtgcataggaaggaggtttcaacagggcacatcgtgttttgcaaatccaccttgagagccatgctcatgggaatcatcagggagaaaataagttcttggatgcagactgcatttgacactctaagataacttgagtcaagttggatcctggcctgtgatagttctgcacaatgggattttcattagtgtgagaagctgagcagtacagtctgagaagttttcacaagaagagatcaaagcaggggtggatggccaaaagcaatctcatgagagaggtgaaagtcttcacaacagacaaaatgagcactggacaggtggacagaaatagggactggctagcacagcaaggaatgtctcagtgtaaaagccacacacacacacacacacacacacacacacacacacgcgcgcacacacacacacacgcacacactaacacagagagagggaccgagagggggtttcctttcaactgtgaaaatgaagcctgcttcccatgagctggaatcctgaactctcagaggagtttgattttacctcatgcaaagacccagaattaattatcagagaaggactggagccatgattgaaggctcaaaagttgttggcttagatatctttggggacccaattttgctggtggacttattcagagctgcctcctccttcttcatcagcatagccaagaggacctatgattgcgcttgttattggatttttctgactggatgcttggagaagagccttcattcccttgaaaactttgctcaggacactggtggaggaagttgatggcatggacctaagagaaagtgttgagtacctgtattgcagctcacatatcatccttaagtccttagagtgagctgaggacccagcaagcacttgagagcaaagggcatggcatgttcacatccaaggcccgagagtaacagcaagtgagatctgtaagggcagtgtgaaggggttggtaagagcaggagtgtagagggtgcctgtgagatatgacaagcccatagtacatggtaagcccataatccatgcggattttcattggtcccactgtaatcggggcatgatctctgtgctgtcttcacagggttgcattccctttccagtatggtccatggaaaacatgcagaggaaatggccccacagcattggctgagtgtttatgtcgtccaaccgagtctccatcgaactgttgtggtgttgctgacttgccctaggtcacctgagttaaaaggtaaggaacatgggaattgctgcatgaattgtaggtgctcaggtcttggtggagcagggaacggctgccattgaatgtgtccaggcccttcgggacatggagcatgcctagggcctctggtttctcccatgtttggagcttcggcccattgttccctggcagtggattgtcagtgtccagcagtccattgctctacccaaagccagaacactccagagtactggaaccacttgatgcaatgcactccaacgtgcttggatctatgatgattcccagtcaaacattccttggaaaagctgaacaaaatgagtgaaaactctgtaccgccactctcatcggaactgaggtccagcatcttgggtctcccaggtgctatgggcgtcaggcacaggctgcccaaccactccatttttcttgacttcttcgggctctagccagactctccagagacaggtgtgtgcttggcctaccctgccaaaaatccatggcataggacacagcaggtccttaagctatggtggcttgctccctttgctgtagtggagatgcttggcagatactcagtaggtagtcttgctaggtccaaggagagggccccagacattgtggaaagtagagtgtgaggcaaaattgcagtggcagtggcaccaaatcttggcttttcacatgggaatatcaagcagtggactcaggcttctcagaagcacttatatgaattttaaccctgttgcattgctttatggagttaatagaatgcaggctgctggtagagtgtagcttgacccagtagcatgtaaacgggactgtgtgactgttgtctgttcaggtggtgaacagaaggctctgtgtccctggcaccatggaagtttcccgggtgattggcttggaaatagagaaggagctaagccttgaaggtgatgacagtcacctcacgggtcagtttgcaccacatttacacacttacctgtgtctgcagacagtgaaactttgatggacaagctgggtgcatgagacttgcagacctgtgtctcgatagatttgttgaaataacttttgtaggaatctcccctttggtaggtgctgttgctttggatgttgttgaagggatatccttggtatatttggatattgttgtcagcctccttggcaaggtaaaagggaaagtctaggaacagttcttgcacccacagccttaagagaaccatcttggtgagggaccctctaaattagagaccaaggtgtcatgggacctttcttttcgatgttttggcctaactcttatggaaagacaagttgctagtgtgcataggaaggaggtttcaacagggcacatcgtgttttgcaaatccaccttgagagccatgctcattagaatcatcagggagaaaataagttcttgaatgcagactgcatttgacacactaagataacttgagtcaagttggatcctggcctgtgatagttctgcaaaatgggattttcattagtgtgagaaggtgaacagtatagtctgagaagttttgaccagaagagatcaaagcagggatggatggcaaaaagcaatctcatgacaaggtggaagtcttcacaacagacaaaatgagcactggacaggtggacataaatagggatggctgccacagcaaggaatgtctcagggtaaaagacacacactcacacacacacacacacacacacacacacacacacacacacactaacacagagagaaagagagagagggggggttcctttaagctgtgaaaatgaagcctgcttcccatgagctggaattttgaaccctcagaggagtttgattttacctcatgcaaagacccagaagtaatgatcagagaaggactggagccatgattgaaggctcaaaagttgttggcttagatatccatggaggcccaattttgctggagggcttattcagagctgcctcctccttcttcgtcagcataggcaaggggacctatgattgcccttggtataggcttcttctgactggatgcttggagaagagccttcattcctttgaaaactttgctcaggacactggtggaggaagttgatggcatggacctaagagaaagtgttgagtacctgtattgcagctcacatatcatccttaagtccttagagtgagctgaggacccagcaagcacttgagagcaaagggcatggcatgttcacatccaaggcctgggagtaacagcaagtgagatctggaagggcagtgtgaagaggttggtaagagcagttgtgttgagggtgcctgtgagatatgacaagcccatagtacatggtaagcccataatccatgtggttttgcattggtcccactgtaatcggggcattttttccgtgctgtcttcacagggttgcattccctttccagcatggtccatggaaaacatgcagaggaaatggcctcacagcattggctgagtgtttatgtcgtccaactgagtctccatcgaacttttctggtgttgctgacttgccctaggtcacctgagttaaaaggtaaggaacatgggaattgctgcatgaattctaggtgcccaggtcttggtggagcagggaacggctgccattgatatgtacaggcccttcgggacctggaacatgcctggggcctcatatttctcccaggtttggagcttcggcccattgttccctggcagtggattgtcagtgtccagcagtccattgctctacccaaagccagagcactccagagtactggaaccacttgatgcaatgcactgcaacgtgcttggatctatgatgattcccagtcaaacattccttggaaaagctgaacaaaatgagtgaaaactctgtaccgccactgtcatcggaactgaggtccagcatcttgggtctcccaggtgctatgggcgtcaggcacaggctgcccaacaactccattgttcttgacttcttcgggctctagccagactctccaaagacaggtgtgtgcttggcctactctgccaaaaatccatggcgtaggacacagcaggtccttaagctctggtggcttgctccctttgctgtagtggagatgcttggcagattctcagtaggtagtcgtgctaggtccaaggagagggccccagccattgtgaaaattagactgtgaggcaaaagtagcggtggcagtggcaccaaatcttggcttttcacatgggaatatcaagcagtggactcaggcttctcagaagcacttatatgaattttaaccctgttgcattgctttatgtagtcaatagaatgcacgctgctggtagagtgtagcttgacccagtagcatgtaaacgggactgtgtgactgttgtctgttcaggtggtgaacagaaggctctgtgtccctggcagcttggaagtttcccgggtgattggcttggaaataagaaggagctaagccttggaggtgatggcaggcacctcacgggtcagtttgcaccacatttacacacttacctgtgtctgtagattgatgaaactttgatggactcgctggaagcatgagacttgcagacctgtgtctcgatagatttgttgaaataacttttgtaggaatctccactttggtaggtgctgttgctttggatgttgttgaagggatatcctgggtatatttggatattgttgtcagcctccttgtcaaggtcaaagggaaagtctaggaacagttcttgcacacacagcctaaggagaaccatcttggtgagggacactctaaattagagaccaaggtgtcatgggacctttcttttcgatgttttggccttactcctctggaaagacaagttgctagtgtgcataggaaggaggtttcaacagggcacatcgtgttttgcaaatccaccttgagagccatgctcatgggaatcatcagggagaaaataagttcttggatgcagactgcatttgacactctaagataacttgagtcaagttggatcctggcctgtgatagttctgcacaatgggattttcattagtgtgagaagctgagcagtacagtctgagaagttttcacaagaagagatcaaagcaggggtggatggccaaaagcaatctcatgagagaggtgaaagtcttcacaacagacaaaatgagcactggacaggtggacagaaatagggactggctagcacagcaaggaatgtctcagtgtaaaagccacacacacacacacacacacacacacacacacacacacgcgcacacacacacacacacacactaacacagagagagggaccgagagggggtttcttttcaactgtgaaaatgaagcctgcttcccatgagctggaatcctgaactctcagaggagtttgattttacctcatgcaaagacccagaattaattatcagagaaggactggagccatgattgaaggctcaaaagttgttggcttagatatccttggaggcccaattttgctggtggacttattcagagctgcctcctccttcttcgtcagcataggcaaggggatctatgattgcccttgttattggctttttctgacgggatgcttggagaagagccttcattcccttgaaaactttgctcaggacactggtggaggaagttgatggcatggacctaagagatagtgttgagtacctgtattgcagctcacatatcatccttcagtccttagagtgagctgaggacccagcaagcacttgagagcaaagggcatggcacgatcacatccaaggcctgagagtaacagcaagtgagatctggaagggcagtgtgaagaggttggtaagagcaggagtgtggagggtgcctgtgagatatgacaagcccatagtacatggtaagcccataatccatgtggttttgcattggtcccactgtaatcagggcatgttctctgtgttgtcttcacagggttgcattccctttccagtatggtccatggaaaacatgcagaggaaatggccccacagcattggctgagtgtttatgtcttccaaccgagtctccattgaactgttgtggtgttgctgacttgccctaggtcacctgagttaaatggtaaggaacatgggaattgctgcatgaattctaggtgcccaggtcttggtggagcagggaacagctgacattgattatggccaggcccttcgggacatggagcatgcctagggcctctggtttctcccatgtttggagcttcagcccattgttccctggcagtggattggcagtgtccagcagtccattgctctccccaaagccagagcactccatagtactggaaccacttgatgcaatgcactgcaacgtgcttggatctatgatgattcccagtcaaacattccttggaaaagctgaacaaaatgagtgaaaactctgtaccgccactctcatcggaactgaggtccagcatcctgggtctcccaggtgctatgggcgtcaggcacaggctgcccaaccactccatgttcttgagttctttgggctctagccagactctccagagacaggtgtgtgcttggcctactctgccaaaaatccatggcagaggacacagcaggtctttaagctctggtggcttgctccctttgctgtagtggagatgcttggcagataatcagtaggtagtcgtgctaggtccaaggagaaggccccagccattgtggaaagtagactgtgaggcaaaaatagcagtggcagtggcaccaaatcttggcttttcacatgggaatatcaagcagtggactcaagcttctcagaagcacttatatgaattttaaccctgttgcattgctttacatagtaatagaatgcacgctgctggtagagtgtagcttgaccagtagcatgtaaaagagactgtgtgactgttgtcagttcagttggtgaacagaagtctctgtgtccctggcagcttggaagtttccccgggcgattggctaggaaatagagaaggagctaagccttggaggtgatggcaggcacctcaagggtcagtttgcaccacatttacacacttacctgtgtctgtagatggatgaaactttgatggactcgctgggagcatgagacttgcagacctgtgtctcgatagatttgttgaaataacttttgtaggaatctcctctttggtatgtgctgttgctttggatgttgttgaagggatatccttggtatatttggacattgttgtcagcctccttggcaaggtcaaagggaaagtctaggaacagttcttgcacccacagccttaggagaaccatcttggtgagagaccctctaaattagagaccaaggtgtcatgggacctttcttttcgatgttttggcctaactcttctggaaagacaagttgctagtgtgcataggaaggaggtttcaacagggcacatcgtgttttgcaaatccaccttgagagccatgctcatgggaatcatcagggagaaaataagttcttgggtgcagactgcatttgacacactaagataacttgagtcaagttggatcctggcctgtgatagttctgcacaatgaaattttctttagtgtgagaagctaagcagtatagtctgagaagttttcaccagaaaagatcaaagcaggggtggatggccaaaagcaatctcatgagagaggtggaagtcttcacaacagacaaaatgagcactggacaggaggacagaaatagggactggctgccacagcaaggaatgtctcagggtaaaagacacacacacacacacacacacacacacacacacacacattaacacagagaatgggagagagtggggggttcctttcagctgtgaaaatgaagcctgcttcccatgagctggaattctgaactctcagaggagtttgattttacctcatgcaatgacccagaagtaatgatcagagaaggactggagccatgattgaaggctcaaaagttgttggcttagatatccttggaggcccaattttgctggtgaacttattcagagctgcctcctccttcttcgtcagcataggcaaggggacctatgattgcccttgttattgactttttctgactggatgcttggagaagagccttcattcccttgaaaactttgctcaggacactggtggaggaagttgatggcatggacctaagagaaagtgttgagtacctgtattgcagctcacatatcatccttcagtccttagagtgacctgaggacccagcaaacacttgagagcaaagggcatggcacgatcacatccaaggcctgagagtaacagcaagtgagatctggaagagcagtgtgaagaggttggtaagagcaggagtgttgagggtgcctgtgagatatgagaagcccatagtacatggtaagcccataatccatgtggtattgcattggtcccactgtaatcggggcatgttctctgtgttgtcttcacagggttgcattccctttccagtatggtccatggaaaacatgcagaggaaatggccccacagcattggctgagtgtttatatcttccaaccgagtctccatcgaactgttgtggtgttgctgacttggcctaggtcacctgagttaaaaggtaaggaacatgggaattgctgcatgaattctaggtgcccaggtcttggtggagcagggaacggctgccattgattatgtccaggcccttagggacatggagcatgcctagggcctctggtttctcccatgtttggagcttcggcccattgttccctggcagtggattggcagtgtccagcagtccattgctctccccaaagccagagcaatccagagtactggaaccacttgatgcaatgcactccaacgtgcttagatctatgatgattcccagtcaaacattccttggaaaagctgaacaaaatgagtgaaaactctgtaccgccactctcatcggaactgaggtccagcatcctgggtctcccaggtgctatgggcgtcaggcacaggctgcccaaccactccatgttcttgagttcttcgggctctagccagactctccagagacatgtgtgtgcttggcctactctgccaaacatccatggcagaggacacagcaggtctttaagctctggtggcttgctccctttgctgtagtggagatgcttggcagatactcagtaggtagtcgtgctaggtccaaggagaaggccccagccattgtggaaaatagactgtgaggcaaaaatagcagtggcagtggcaccaaatcttggcttttcacatggggatatcaagcagtggactcaggcttctcagaagcacttatatgaattttaaccctgttgctttgctttacgtagtaatagaatacacgctgctggtagagtgtagcttgaccagtagcatgtaaactggactgtgtgactgttgtcggttcagttggtgaacagaagtctctgtgtccctggcagcttggaagtttcccgggcgattggcttggaaatagagaaggagctaagccttggaggtgatggcaggcaccccacgggtcagtttgcaccacatttccatacttacctgtgtctgtagacggatgaaactttgatgtactcactgggagcatgagacttgcagacctgtgtctcgatagatttgttgaaataatttttgtaggaatctcctctttggtaggtgttgttgctttggatgttgttgaagggatatccttggtatatttggacattgttgtcagcctccttggcaaggtcaaagggaaagtctcggaacagttcttgcacccacagccttaggagaaccatcttggtgagagaccctctaaattagagaccaaggtgtcatgggacctttcttttcgatgttttggcctaactcttctggaaagacaagttgctagtgtgcataggaaggaggtttcaacagggcacatcgtgttttgcaaatccaccttgagagccatgctcatgggaatcatcagggagaaaataagttcttggatgcagactgcatttgacacactaagataacttgagtcaagtcggatcctggactgtgatagttctgcacaatgggattttcattagtgtgagaagctgagcagtatagtctgaaaagttttcaccagaagagttcaaagcaggggaggatggccaaaagcaatctcatgagagaggtggaagtcttcacaacagacaaaatgagcactggacaggtggacagaaatagggactggctaccacagcaaggaatgtctcagggtaaaagacacacacacacacacacacacacacacacacacacacacacacacacactaacacagagagagggagagaggggggttcttttcagctgtgaaaatgaagcctgcttcccatgagctggaattctgaaccctcagaggagtttgattttacctcatgcaaagacccagaagtaatgatcagagaaggactgtagccatgattgaaggctcaaaagttgtttgcttagatatccatggagacccaattttgctggtggacttattcagagctgcctcctccttcttcatcagcataggcaaggagacttatgattgcccttgttattggctttttctgactggatgcttggagaagagccttcattcccttgaaaactttgctcaggacactggtggaggaagttgatggcatggacctaagagaaagtgttgagtacctgtattgcagctcacatatcatccttaagtccttagagggagctgaggacccagcaagcacttgagagcaaagggcatggcatgttcacatccaaggcccgagaataacagcaagtgagatctggaagggcagtgtgaagaggttggtaagagcaggagtgttaagggtgcctgtgagatatgacaagcccatagtacatggtaaacccataatccatgtggttttgtattggtcccactgtaatcggggcatgttctctgtgctgtcttcacagggttgcattccctttccagtatggtccatggaaaacatgcagaggaaatggccccacagcattggctgagtgtttatgtcatccaaccgagtctccatcgaactgttgtggtgttgctgacttgccctaggtcacttgagttaaatggtaaggaacatgggaattgcttcatgaattctaggttcccaggtcttggtggatcagggaatggctgccattgatatgtccaggcccttcgggacatggagcatgcctagggcctctggtttctcccatgtttggagcttcggcccattgttccctggcagtggattggcagtgtccaacagtccgttgctctccccaaagccagagccctccagagtactggaaccactttatgcaatgcactgcaacgtgcttggatctatgatgattcccagtcaaacattccttggaaaagctgaacaaaatgagtgaaaactctgtaccgccactctcatcgaaactgaggtccagcatcttgggtctcccacgtgctatggtcgtcaggcacaggctgcacaaccactccattgttcttgacttcttcgggctatagccagactctccagagacaggtgtgtgcttggcatactctgccaaaaatacatggcataggacacagcaggtccttaagctctggtggcttgctccctttgctgtagtggagatgcttggcagatactcagtaggtagtcgtgcaaggtccaaggagagggccccagccattgtggatagtagactgtgaggcaaaagtagcagtggcagtggcaccaaatcttggcttttcacatgtgtatatctggcagtggactcaggcttctcagaagcacttatatgaattttaaccctgttgcattgcttacgtagtcaatagaatgcaggctgctggtagaatgtagcttgacccagtagcatataaacgggactgtgtgactgttgtctgttcaggtggtgaacagaagcctctgtgtccctggcagcttggaagtttcccgggcgattggcttggaaatagagaaggagctaagccttggaggtgatggcaggcacctcaagggtcagtttgcaccacatttacacacttacctgtgtctgtagatggatgaaactttgatggactcgctgggagcatgagacttgcagacctgtgtctcgatagatttgttgaaataacttttgtaggaatctcctctttggtatgtgctgttgctttggatgttgctgaagggatattcttggtatatttggacattgttatcagcatccttggcaagttcaaagggaaagtctaggaacagttcttgcacccacagccttaggagaaccatcttggtgagggaccctctaaattagagaccaaggtgtcatgggacctttctttttgatgttttggcctaaacttctggaaagacaagttgctagtgtgcataggaaggaggtttcaacagggcacatagtgttttgtaaatccaccttgagagccatgctcatgggaatcatcagggagaaaataatttcttggatgcagactgcatttgacacactaagataaaatgagtcaagttggatcctggcttgtgatagttctgcacaatgatattttcattagtgtgggaagctgagcagtatagtttgataacttttcaccagcagagatcaaagcaggggtggatggccaaaagcaatgtcttgagagaagtggaagtcttcacaacaggcaaattgagcactggacagttggaccgaaataggcactggctgccacagcaaggaatgtctcagggtaaaagacacacacacacacacacacacacacacacacacacacacacacacaaacacacacatacacacacactcactaacacagagagagggagagagacggggggttcttttcagctgtgaaaatgaagcctccttcccatgagctggaattctgaaccctcagaggagtttgattttacctcatgcaaagacccagaagtaatgatcagagaaggactggagccatgattgaaggctcaaaagttgtttgcttaggtatccatggaggcccaattttgctggtggacttattcaggacactggtggcggaagttgatggcatggacctaagagaaaatgttgagtacctgtattgcagctcacatatcatccttaagtccttagagggagctgaggacccagcaagcacttgagagcaaagggcatggcatgttcacatccacatcctcgccagcatctgctgtcacctgaatttttgatcttagcctccctaagtcttaaaatccctttatcaaccctaagccacagaatatcaggcatctccaagtcatttccagtaggccatcttttgataaaaacctcagccaaccattcaaacaaacttttgacaccttttttaactatgtgagcttctgtattaaacctagaatctcttctcagaggacccatgtcaataaactcagcctgctctagttttatgttccttccacccttatcccacacccttaaaatccatttgcacgcatattcacaggttttgcttgaatgaattagcaaactcattaagctccttagtagtgtagcgaatttcctcatggactacactttctacctcccctctaggagcctgttttgctttgagtctggttacaggtctagaagaaactattggtgggccttgagaaacatcagtagtgaaagtcattgctggtttatcagactctgcaaaagtaatttcctcgtgtggggaaggcattatttcaaggggtggggctgagggtactacttcctcaggtggggcaaacccttgagaatctgaagattcaaaattctcagcttcaacatggtcttcccacacatccccgtcccttgttataggatcccattctttgccaattagagcccttactttaactgtcgacacactctgaggctgagacttgaattttcgctgtagttcagccaaccttacaatgagggtttcagtttgattttctgcaacttgagctctattgctacaagagagaagattctcttcaaggacacacttatcaacttttagatcgtttacttgtgtctggagcctttcgattttatcacacaacttcctttcattcatcattttttccacagatactaagagcagccagccagtaaaatcattttccgatttttttccccagctttgtgcactgaatcacctaattcattaagaaaatcaagggcattagcttctttaagttcgaaatgtagtttcaaccatgggttttcaaaattctctgagctcccaggagggagagaatctggagaggtttcaatagttgaaagtgctggtggatcaacaagccaattccagtattttaaaagattcatccttgtacttctgttactctagaaccactcctggtaccaacttctgtattagtcagggttctctagagtcacagaactcttggatagtctctatatagtagaggattttaatgatgacttagagtcggcagcccaattcccaacaattgttcagtcacagctgtgaatggaagtccaaggatctagcagttactcagtctcacacagcaagcaggcgaaggagcaagagctagactcccttcttccaatgtccttatattgtctccagcagaaggtgtagcccagattaaaggtgtgttccaccacagctttaatcccagatgaaaggtgtagcccagattaaaggtgtgttccttaaactcggagatttaatcttctggaatccatagccactatggctcaagatctccataccaagatacagataaggatctccaagcctccagacaagggtcactggtgagcctcccaattctggattgtagttcattccaaatatagtccaattgagaaccaggaatagccactacagtattttactctagatttgctctagtctcatctttaaggaagtgataggaggctaagtctcaccaaacacttgaaagtaatgggagtgctatgttactagacaattgctgagaggaatagagttctcactctggactggatagtccaaggacttggcaggaagtgttgacagcctcaatgtgttctgaccattccaaaatacatattaagcacatcatccatctcaatgtgcatggtgccatctaaatggctgcatatgttctttgttttcttcacagagatgcattccttttccttcatgggccatgagtgacatccagagaaagtgtcaccacaacactggacaaaagttgatgatatctgaatgagctaccagtaaacccccccctttttttgctgttattgccttgcctgaggaaaagcgagttaaaaggtaaggaatgcataaatttcccccaagaattcaaggtgctcaagactttgtggaccaaagtgctactttacagatatcccacagttttgacatgtataataccttggggtccagaacaaattcaggcttcattttcaatagtatacatttctctcagcactactatcttgtaacctcctattagcatagcatactaacctgttcttacagcattccaccattttaagttcaaagttctaaatcattctagaatcctgcaaaaaaaaaaaaaaaagaccagttggttcttcacagcaattcaacattccttttaccaaattctgttttatttagttatttttgctgtaataaatcaccatgactagggaagcttaagaaagaaaggatttaattggaattattgttgtacaggattggagtctttgatggcacaattatccttgacagcaagaacttttgtgatcttatatcttgatatacaaccaaaaggcaaaaagaacactaataatggtatgattctttgaaacccagtgcccacctaacatgacatatctcattcaacacgttcacaacttttaaacctctcacaccaatttcaaactaatgattcaaaccggggagcctatgtagggcattatcattctaactgccataggaaggtttttggtaaatgtagtctgggtttcttttagtcattctcatatatattttatttgtatagaaaatgtaattttaatttcctgaaatgtacaatgttttggtatgctctacatgagtttattggtcaaactgtttaacaggctgatattatcttttaaaaaatctttgtagtgtttttatatatcagtttatattttgtcactaaaaagtatttctttgtatttttctcctcctatctaattaatagactaatcatctcctgatgactcttttcattctttttctagaaaagtatttactcaaaactaagtattcaaaactaagtattttatgtaaatttattttattccaggaatgtagaaaacgtgacaaattattttatctgaaatcattgtcctagaatttaaactataaaataaagaatgaatgaagaaagcatagaatctatagtccctagattgtggttgttacttttaagcttgcaaagaatgtatatgaaaacaaagaaagaacaatgaaaagaagaagaagaagaggaggaggagaaagaagtgaaagaaaaatagaaagaagaagagtaaaaaagaaagaagtagaagcagcagaaacaaaagtggaagagaaggaaaagaaaaagcagaaaaagcagaagaagaaggaaaaggaagaagaggaggaggaggagaagaaaaaagaaaggaaaaaagaaagaagaaaaatgacaccactacatttatgataggaagttataaagtctttttctttttttttttctagccactctatgaatccgtgcttcaaagtgactttccctatgtagtgtaaccatatatgttctatctcatgtaaatgtacagtataatattttccaaccctcttcctctttaggacatgtgttcgttcctaaactctgccatttttcctgtctcctggcagatgatacctacagtgatgagttggagttatagatggtgccatttcttctaccagcagcttcaccaaaacaatctccattatacatgctgatgcctctttcctgtgtagcagcagacaccacctgcagataagaaatgcttaagtgagaaatgctcattttgggatatcatcgctgaaactataatttgggcatggtgactgtttcccttgctgccacttgactcaatctcagaagtttaatagatcaaataatattgtacaatatgctcaaaatggtggaagtaattagtgctcctataaatatatattgacaatttaaatataacatattaaaaataaaatgcatgattaaacaaacctgaatgcatacttatataattaatacataaaatatgtgctgcctcttttttgaaggctatccccatagtttctctctgttaagagaaggatatacatgcttttaagcaataaatatacaagcagatacacatactgtctggtgggggcacttctagtagtaatgccatattattatgcaaattgctacttttgtttgagtctttttgatgagcttttgctactatgtcatttattgaatgactatatgactgttttgtagatgaaatagaattaaatattttaaatattgcttatacatgcatttatataggtgctaattttctgtgcaatagacttccgtatatattaacatttatgcattcatctcctctattaaagtaaatttacctagaacacaaattattgaaattaagtatattgacacttaatatttttataattgttatgattcctttaagaatgtgcttgaagagctttcttgtaagaatcaatgaattagattgcccaatttttcaaaatacaattatggtagattttacaaatgattgagatcctttccagtgtgttagcccaaattgttgctctgacttgtatttattttatttttgagtttgatcattttcatgtttaatagccatctgtattattttaatttcctatttatctcaaaacttgggagtatttagtctctttaatgatcttatagtatttgggaaagataagattttggattgtcaaacattacatgtttgtcacacttttaaactttgttttgttatcagaatgcgtattattcttacatgtccaaatataaccatgtttgcttttatggcttctgagtttcatgtcatttaaaaaaatattctgaacccataaagcttttcacctatgttaattctaattattttgtgttttttaaagtcaaattcttatgtcatgaaaaaaattttattttgaaatcttacagttgcgaagttatttgccattacttataattatttgccaataattgcccacttatctgtaatgccatcttgcatatgtgctgtattctcatccatgaatggctccatttttgttttgtggatatgtgtgtctcttctcccttctgtctcatgtgtcttcttgttggaagaagttacagtatagactgtaatttcatcaatcttaataaattaatctgggaaaaacttgttttaaatgatactgtcttcataaataaggacaaggtatgtctcttttattaaataattaattattgttgatattttcactgtgatgttgggcttttctctcttttttgcttatttatttggttttaaagttttttagattttgttttaggggcatgagttaagtggccctgttacttctttttattatatatataatgtaacaattttgcaaatactgatttttctcccaatccaattgataacaattatggttatgctgataaaactccacaaactggtaatctcagagcacttaagcaattgtggaaatattatcctcccttgatttaaatgggatttcccacaatgctttgtggatatgagtagcacattgctactctcctatatttccaaaaagaccaccttgaaggagcaatgatcaagcaaagttgagtttactaaacttattgcagcaagggaaaacaacaccataatagggcttagtagtggttgaaaggcaaaataacggcctttctacctggactactagggtatgaggcatagacaaaaacaacgaatgggcccaattaagcatgcaatactttaagatggattggggtagaatgtgttcctaatgtgcttcctgaaaagtaaattgctatctaagtgagtctttggcctcaataagatattagcgacagaccaatatttatctatatatgcaaatagaatttatcacttaatagttggtcttgctgagcaggactctactattggtgttatcaggtcttactctcaaaaggtaagttatttttttcatatgactggatgtaagtataaatgtaatattgtaactttaactttgagatatttgatatattatgttaggaagattgtacttccatttttcatattttttaggaatttgaatttaagccagctggaggatgtaattgctactttttacacaaacacttgtactatatttttaataattatttattgccataaaatattttattttcaatcattaggtatccttttattccatgcttgggcatactcatttaattcatttaatttattaactcatttaattcatttaattctctgtatttgatttggacatttttgagttcatatgattaaatgaaatcacttttccattcactttcttatctatttctctcattcatttgtgttagaatttcttattatgtttaagtaatgtagtgaattttcatctgtgcagtgatcaatgggttgtgaccatggttaattatgcacatccgtgaaatctggtctttgatggataataaaatctctgagttcagatgagatcgggcacgttcagggtggtatggcctattgtcataactggtagaattattttaatccctaatctaaaactctgacattcttgtagtttccctttggcattcagaacataaaacctgtgtgccacaactggcaaaaggccagttatttcctcggacccttgcttggaaaattcaccccattagtgaattagtgcattagttctgttgtggttctgattcaacattctcttgttcctatcaacattgctgtgattttccagtaatccccactttaggaatgtagttttgctctatgtaagatacataaaccatgttgtctacagaactttccaagagggaaactaacgatgatattggtcatgattttggagttaataaatcaacaaataacatgatatgctctaaaaaaaaactctaagcttgttcacattactacatatcatttgtttcatatcagatatataatgtttattatttgctcacagaagattacaatgcactcagattttctatcacactatttatactctatattttcaaatgagtaagttgcacatgtggatttttagaataacccattttcttctttcattcacaatcaagattttagatttttttcaggttttaaaaatgttccaaatacatttatacattttccctatgcatatttcataataattgtttaaaattttaatccattaattttcatttgttcttgataaaaattatgttaccatacatactttctgacataataaacatggcacatgagagataaggaaagtgatgatctctatattaggccaacagcctatgctgttacattattaatctgctgtgtgttcttttttaatttatttattagatatattctttatatacatttcaaatgctatcccgaaagttccctatacctccccctgccctgctcccctacccacccactcccacttcttggccctggtgttccccagtactggggcatataaagtttgcaagacaaaggggcctctcttaccaatgatagccgactaggccatcttctgctacatatgcagctagagccacgagctctgggggtactggttagttcatattgttgttccacctatagggttgcagatccctttagttccttaggtactttctctagctcttccattggggccctgggttccatccaatagctgactgtaagcaaccacttctgtgtttgtcaggcattctgaatgatattttaaaaaccattttaaatgagtggttggttaagtgacttaggtatgtatgacttaatttgaaatcatagaacccatgattgaaaagttgaatgtggtgttacattattatatatgtgtatactgcctttgctagtaatcagacacagcttgatggctctggttcactgtaaaccactctatcttaatcactgaccaccagaaaaatgagagaccctgaattaaaagcaccaacaaacaaaaatattaaacatgctaagacagattattcttaataacaacacctacagctattgttctggcttcatcacagccatattccctgctacaaagcactaccaaacacacatatgcctagtaactcaaacatgcacaaacaaaacattattaaatgagtgaggtttattttaactatttctcccacaaaaaattgcaatattttcattaattatccattccttcattaattctggagggggtgcacacatttgccatagtgcacatgaaaaatcagagggcaacctttatttagatcttctagtatctaggttctagggattgattgcaagacatgaggcttggtcttaagtacatttacctattgaggcaccttggtggctattttaaaacatatttaagtgactttgtgtattaaaaaattcatagtttgcaaactgacttcaaatatttataattcttaactcgaggatctctggccatgctattctttcttctccatagataactagtggtactacatcattctcattgtcacagtatctcccattctctcatacagcctcaattctccaaggtatatatccattagaagtattttccttttttatcaatcatttttattatttaaatttcaaatgatatccaccttccaagatacccatacacaaaatccccataccatcttccatcactcccctcccttttgcctcaatgaaggtgctctttgacccacataaccagtcctgcctcactgctctagaatccccctaagctggaccaagggacttccctcccattcctccctctatgtatactctttacttggtggtttagtccctgagagctctgggtgatccagttaattgatattgttcttatagaattgcaatcctcttcagctatttcaatcttccattggtgcctccagataagcctgattgttgtttgtgagtatctgcatgtgtattagaaaggtgatcatagaatgtctcatggaatagctgtattagactcctgtcagcaagcattttgtgtcattagcaatagtgtaggggtttggtgtctttaaattagatagattcctcagtggaggggtctctgtatggccttttcttcagtttctgttccatttctgggcatatcattcctttggacaggaaaatttctgggttaaaacttttgagatatgtgggtggcaccatccctcgactagggggcatgcctatctactggaggtggtatctacagattgtatctcccctttcttgggtaatttggataaagtcatcaccattgggtcctgggagtcttttgcttccctggagtatcagactttctagaggctaaatccggttccctattccccactgctgcctgtttctatgcagttgatacagttgttcttcctatggagttgcaatcatttcagttccttcgatagtacccctaactcttcgataggggtcccaaacctcagtccaatttttgcctgtaaatatctgcatgtgtctaagtcagctgtggcagatcctctcagaggacagccatgctaggctcctgtatgcaagcataacatgacatcaataatattgtcagagtttggtgcaatgcatgatatggacaccatgttgggcccatcactgggtggcttttgctttagattctgcacaattcttgtctcaacatttcctttagacaactacaattctgagtcaatgaaatttgaagatggatgagtgacaccattcctttacttgaggtcatttctatctactggaaatggttatttcagggtccatctgccgattgttgagcattttgacaaaggtcatcctcattaagtcctgggaactttttatattccaagtctctctgagactttctagagtttccctccacccaatgctgctgcatatttcgatttattctcctggccccctggacttctatgctgtttccccccatatttaatattgtccccctttacaccttccactcttctctctcatcatgatccctggctttctctgactcctttgattgcttttccccttttaaatggattcaagaatccacagttgtgccttctttcatgttaaacttcatagagtctgtgagttttttcatgggtattctgaattttttggctaatatccacttctccctgagtatatgcctgtctttttgggtctaggttaccacattcaggatgatattttgtaattgtgtacatttgcttgaaaagttcatgatgtcttcacttttaatagctgtatattattccactgtaaaaatgaacacattttttgcatccattcttttgttgatagacatcttgggtatttccaccttctggctgttacaaataagggtgctatgtggaatgcctgttcttgtggtatatgggacatcgttgagtatatggccaggagtggtacagttggatcttcaagttgaactatttccaattttctgaagaactgccaggatgattttcagagcagttgttcaagtttgcaattgaaccagcaatggagtactgttcctatttctccacattcttgctagaatgtgctatcaagtgagtttttttatattagccattctgattgttgtattgtggaatctcaagttcattgtgatttacatttccctgataactaagaatgttcaacagttcttttagtgcttcttggaaatatggtattctgttgaaagttcggtgtttaattctgtacccaccttttaaattgagttatttgttttttgaagtctatattcttgtgttctttgtataaaagccctgtatcagattcaatattagtgaagatttttccaaatcagtaggttacattttattctattgacagttttgtttgcctagtaagttttcagtttcatgatgtcccatttctcaatttctggtcttagagactgaaattaaaaaaaatatataatcaacaaaatcataatgtaatggatgttattctagtcagataaaatggagccccagttaaatccagatcaggtaaactataaaaagttccataaaccctaagaaaatagaagcagtcattaaaacctccaaataaagacagaccacggggtatagttcagtcttcaggggattcccagcatacatgcaaggtccccattgctgtcttcagatgtaccagaagagggcatcagatctcattacaggtggttgtgagccaccatgtggttgctggggtttgaactcaggaccttcagaatagcagtcagtgctcttgcccgttgagccatctcaccagaatagcagtcagtgctcttgcccgttgagccatctcaccagcaaactttatatgccccagtacaggggaatgccagggccaaaaaggggcagtgggtgggtaggggattggtggggtgggtatgggggacctttgggatagcattgaaaatgtaaacgaggaaaatacctaattaaaaaaatacaatttaaaaaaaaatatagtccataaaacagcagcaatagcctcatcaggaactagtaataggcaaattctcaggtgctgcagtatttctattgggtcagttgtctgtatcaaaccattgatgcatcaatgatacattgatgcacccagttaatttgcagacatgttcaatcttgagacctttgcactaagtcaaagggtctgtatggggatgtatgtgttagaaactgggcacactctataaatgtaattgttataaagcagtatataaagatactgttcctcattaaaaaaacaacaacaacaacaacaacaaaaaaaaaaaacaacaaaaaaaaaccctccaaataaaataaaggcctgggtgagatggtcttttttatatatatatatatattttattaggtattttcctcatttacatttccaatgctatcccaaaagtcccccataccctccctcccaataccctacccacccactcccacttttttgccctggcattcccctgtactggggcatataaagtttgcaagtacaatgggcctctctttccagtgatggcctactagaccatcttttgatacatatgcagctagagtcaatagctccggggtactggttagttcatattgttgttccacctatagggttgcagatccctttagcttgttgggtactttctctagctcctccattaggggccctgtgatccatccaatagctgattgtgagcatccacttctgtgtttgttaggccctggcatagtctcacaagagacagctatatcagggtcctttccgcaaaatcttgctagtgtatgcaatggtgtcagcgtttggaggctgattatgggatggatccatggatatggcaatctctagatggtccatcctttcgtgtcagctccgaactttgtctctgtaactccttccttgggtgttttgttcccaattctaagaaggggcaaagtgtccacaatttggtcttcgttcttcttgtgtttcatatgttttgcaaattggatcttatatcttgggaattctaagtttctggactaatatccacttatcagtgagtacatatcatgtgatttccttttgtggatgggttacctcactcaggatgatgccctccaggtccatccatttgcctaggaatttcataaaatgcattctttttaatagctgagtagtatcccattgtgtaaatataccacattttctgtatccattcctctgttgacaggcatatgggttcttttcagctcctggctattgtaaataaggctgctataaacatagtggagtatgtgtccttcttaccagttggaacatcttctggatatatgcccaagagaggtattgctggatcctcccgtagtactatgttcagttttctgaggaaccgccagactgatttccagagtggttgtacaagcttgcaatcacacgaacaatggaggagtgttcctctttctccacatccttgctagcatctgctgtcacctggattttttatcttagtcattcagactgctgtgaggtggaatctcagggttgtttatccctgcatttccctgatgattaaggacaccgtacattttttcaggtgcttctcagccattcggtatacctcaggtgacaattcttcgtttagctctgagccccatttttaatggggttatttgattttctggagtctaccttcttgagttctttatatatattggatattagtcccctatctgatttaggataagtaaagatccttttccaatctgatggtggcctctttgttttatttacggtgacttttgccttacaagcattgcaattttatgaggtcccatttgttgattctcgatcttacagcacaagccattgctgttctattcaggaatatttcccctgtgcccatatcttcgaggcttttcctcactttctcctctataagtttcagtgtctctggttttatgtggagtttcttaatccacatagatttgaccttagtacaaggagataggaatggatcaattcgcattcttctacatattaactgccagttctgccagtaccatttgttgaaactactgtctttttttcactggatggttttagctcccttgtcaaagatcaagtgaccataggtgtgtgggttcatttcagtgtcttcaattctattccatttgtctacttgtctgtctctacaccagtaccaggcagtttttatcgcaattgctctgtagtacaacttttggtcaggcatggtgtttccaccagagattcttttatccttgagaagagtttttgctatcctaggttttttgttattccagatacatttgcagattgccctttctaattcgttgaggaattgagttggaattttgatggggattgcattgaatctgtagattgcttttggcaagataaccatttttagtatattgatcgtgacaatcgatgagactgggagatttttccatcttctgagatctttttaatttctttttcacaaacttgaagttcttatcatacagatcttttacttccttagttagagtcatgccaatgtattttatattatttgtgactattgagaagggtgttgtttccataatttctttctcagcctctttatcctttgtgtagagaaaggccattgacttgtttgagttaattttatatccaggtacttcactgaagctgtttatgtggtttaggagttctctggtggaatttttagggacacttatatatactatcatatcatatgcaaaaagtgatattttgacttatttctttccgatttgtatccccttgatctccttttgttttcaaattgctctggctaggacttcaagtacaatcttgaataggaatggagaaagtggtcagctgtgtctagtctctgattttagtgggaatgcttccagcttctcaccattaactttgatgttggctactggtttgctgtagattgcttttatcatggttaggtatgggccttgaattcctgatattaacaaggcttttatcatgaatgggtgttagattttttcaaatgatttctcagcatctaacgaaatgatcatgtggtttttgtctttgagtttgttcatatagtggattacggtgatggatttccatatattaaaccatccctgcatcactggaatgaaacctacttggtcaggacagatgatagttttgatgtgttcttggattcggttagtgagaattttattgaggatttttgaatcgatattcataagggaaatttgtctgaagttctctatctttgttgggtctttctgtggtttagctatcagagtaattgtggattcatagaatgaattgggtagagtaccttctgcttctattttgtggaattgtttgtgcagaattggaattaggtcttctttgaagatctgatagaactctgcactaaacccgtctggtcctgggcttttttgattgggagactatttaggggatatagggctgtttagatcattaacctgatcctgatttaactttggtaccttgtatctctttagaaatttatccatttcatccaggttgtccagttttgttgagtatagccttttgtagaaggatctgatggtgttttggatttcttcaggatctgttgttatgtctcgcttttcatttctgattttgttaatttggatgctgtccctgtgccctctagtgagtctggctaagggtttatatatcttgttgatccagctccttgttcggttgattctttgaaaagttcttcttgtttccacttggttgatttcacccctgagtttgattattttctgccttctactcctcttgggtgaatttgcttccttttgttctagagcttttaggtgcgttgtcaaactgctagtgtacactctctctagtttcttttttgaggcactcagagatatcagttttcctcttagaaatactttcattgtgccacataagtttgggtatgttgtggcttcattttccttaaactctaaaacgtctttaatttctttctttattccttccttgatcaaggtatcattgaggagagtgttgtccattttccacgtgaatgttggctttctattatttatgttgttattgaatatcagccttagtccatggtgatctgaaaggatgcatgggacaatttcaatatttttgtatctgttgaggtctgttttgtgaccaattatgtgggcagttttggagaaggtaccatgaggtgccttttgttttaggaaaaaatgttctgtagatatctgttaaatccatttgtttcataacttctgttagtttcactgtgtccctgtttagcttctgtttccatgatctgtccattgatgaaattggtgtgttgaagtctcccactattattgtgtgaggtgcaatgtgtgctttgagctttactaaagtttctttaatgaatgtgggtgcccttgtatttggagcatagatattcagaattgagtgttcctcttggagggttttacctttgatgagtagagttggcattctgttcttgtggctgtcttcttttaggtttgttgaaggattactttcttgctttttctagggcttgttttctgtctttgtattggatttttttctgttattatcctttgaacgactggattcatcgaaagataatgtgtgaatttgttttttgtcatggaatactttggtttctccaaaattgaaagtttggctgggtatagtagcctggctggcatttttgttctcttagtgtctgtatatcatctgtccaggttcttctggctttcatagtctctggtgaaaagtctggtgtaattctgataggcctgtctttatatgttacttgacccttttcccttactccttttaatattctatctttatttagtgtatttgttgttctgattattatgtgtcaggaggaattttatttctgacccagtctatttggagttctgtagacttcttgtatgttcattggcttctctttctttaggtttgagaagttttcttctataattttgtttaagatatttgctggccctttaagtggaaaatcttcattctcatctactcctattatccgtaggtttggtcttctcattgtgtcctggatttcctggatgttttgagttaggatctttttgcattttgcgttttctttgatcgttgtgctgatgttctctgtggaatcttctgcacctgagattctctcttccatctctcatattctgttgcttccatttttaggtctagtgtgattttgttcatttccatcacctgtttggatgtgctttcctgtttttctttaaggacttctacctgtttggttatgttttcctgtttttctttaaggacatgtaactctttatcagtgttctcctgtatttctttaagtgagttattaaagtccttcttgatgtcctctaccatcatcatgagatatgcttttaaatctgggtctaggttttcagatgtattggggtgcccaggactgggtgaggtgggagtgctgcattctgatgatggtgagtggtcttggtttctgttagtaagattcttacatttgcctttctccatctggtaatctctagagttagtttttatagttgtctctggttagagtttgttcctcacatgattctgttagcctctatcagcagacctggctgagtagctctctcctgagtttcagtggtctgagcactctgtgctggcaagctctcctcttgtagggaaggtgctcagatatatggcgtttggacctgcctcctggcagaagatgaaggcctgaaacagggcctgtcccagaagctgttagcttctgtagtcaacactctcacctgtgcagattagtctcagagtaatccgggaaccaatatggctgcccgaggtgctccagcaaagtcctccttggcagggagcacacctgtcctctggcagggaaggtgcccagatgtctggagctgaaaacagggtctgcctcagaacctgtcctctagtcaccttggggatgtcctctgactcctcctgcaggtgacctggggctggcgcagactggaagggacttgtgaccctggtcagaccgggttttcggcttccctaatgctgtctcaggtcccacacgattggaatggaacagaagttgttttcactcactggtggtcttaagattgcatggagagtcctctagggacctgggggttgggctgtccactgacttcgtgcccaaggtgcttccctaatgctgtctcaggtcctgcatgattggaatggaatagaagttgtgttccactcactggtggtcctaaggtcgcgtggagagtcctctagagaccttgggagggtgtcagccaactctgcaccaggtcgagatggtcttaatacagaattctaccatcccttaaaaaatatctaataccaatactcctcaaactattccacacaacaaaaatgtaaggacctcatcctaattaattctatgtaaccacaggtactccaatatctaaatcacataagaagagaatttcagacaaattttgcttgtgcatatcaatgtaaatatactcaataaaattcccaccaaacaaacctaagaacacttcaaaaccatcaaatactatcatcaagtacacttcatcctagaggtaccaggatagttcaatatacaaaaatcaatgaatgaattccactatataaatacattcaaataaaaatcacatgatgatccaatcatatactaaaaaaggcctttgacaaaatacagcatactttcatgtttaaagtctaggagggatcagaaattcttcacatacatataaacatgttaaaacagtatacaaaagactaacatccaacaaaaaataagtggagaggaattgaagcaatccctctaaaatcaggaagacaaggctgcccactctctccctatatattcaatatagcactctagctatagcaattaaacaaaaggcgatcaaggggatacaagttggaaagaaagaagtaaaggtatcactatttgtgggtgtatgataatatatataatcaaccatagaaattctactagagaactccttcacctgataaacaaattcagaaaagtagccgaatatgaaagtaacttaagcaaatcagtagccttcctttatacaaatggtaaatgggctgagaaagaaattagagaaacatcacctttctttttttcccattttttattaggtatttagctcatttacatttccaatgctataccaaaagtcccccatacccagccacccccactcccctacccacccactccccctttttggccctggcattcccctgtactggggcatataaagtttgcaagtccaatgggcctctctttgcagtgatggccgactaggccatcttttgatacatatgcagctagagacaagagttccggggtactgcttagttcatattgttgttctacctatagggttgcagttttctttagttccttgggtgctttctctagttcctccattgggggcaaactatataagcaatcttggtgtaaatttaaccacccaagtcaaagatccatataagaagaatatcaagtgtctcagaaagaaattgaataaaaagttagaagatggaaagatctcccattctcattgattgataggattaactagtaaaaatggctatcttaccaaaggaaatctacagattcaatgcatttcccatcaaaacgctaacacacttcttcacagacatggttaagggcaattttaaacatcatatggaaaaccaaacaattttcaacagtaaaagaactcctggggggtaatcaccatacctgaccttgaactgtagtacagagcaacagagatgaaaaccacatggtacagacagagacagacaggtcaatcaatggaatagaattgaagacccaggaataaacctatacacctatggaacttgatctttgacaaagaagccaaaagcatacaatggaaaaaagaaaacatcttcaacaatggttctggtctaaatggttgtctgaacgtaacagaatgtgaaatgatccatatttaccattttataaaactcaagtccatgctggtcaaggacctcaacataaaaccagatacactaaacctaatagaagaaaaatggtaaatatccacaaatgcattggcacagggggatatttcttgagaacaccaatagcctgggccctaaggctatttttattgttacatatttcaaaaataaaaaagtgtgcatctaaaagacaaggatattatgtttcaaactgggaactaaatgttgaggtctctatttaatatatcaaaatggacaaagcagtcagattctcccaggatcccttattccttagctgttacagagaatggctagaataccttgcctcctttcctaaaattttcaccccagatgctgagcagcccttccactaggggctgttgcctatataatcctgctcttttgtacctttgacatcatggctacaatacctttttcccttccctcctttttttcttccctccctttgtatgctcacatgcctaatggccatgctcactctagacacactctgatgtggatatgctctctattttgcctacactaaactttcccctccaccctacgtagaagcaagcatgtactttccttttattttatttctttttttccctgctttcatctgaaagagtttttcatgatgacatgacattcagaaattctcaaattttggctcacattcatcttcgttatagttataatttacaaatattcaaagtgaatacattggtatataagtaaatgtctttaaaagcatacttacattgagcatttttgttcattctaatagtcactagttttggggggatttatgtgttttgccacattaactcccttccttaacttgtcccagatccactacctatcattaactgctctgttttctgtcctcgtttttcttgaaccctctgtcttaggtagttttctactgttctgatgagacacaatgatgaagacaacttatgaaataaaacttttatttggatggtagtttatagttctagggctggagactatggctatcatggcataaaatacatcagcaggcaaataggcatgccactatactagtagatagaacttaaatcctaatttcaaattgaagataaggagaaacagcaaacttgtaagagtgagtttggtgtgagctattgaaattccaaagtccatcctcaatataatactgtcaacaatgccacatgttttaatcctttcttacacaattgtactaagtataaacaaagcatacaaataaatgagattctgtagtttattgtcattcaaactatcattttctataccttgcacccataggcttagcaatatcatacagaaaagagcatttaatcatttttcagtcttcataatacttcacagtctccatcctgtttgaaagttcaatcagcaatgttatttaaagggtaagtttttcttacattttattccaatctcttaattgtaattccctgtaaaaaacacaaccaaacattatatttcatgattataatagacaatggtaaagtatatatattatcattctaatgatagaatgaagagaaagtagagtgaggaaacagtgaatcaaaccaaactaaatcccagcaaggcagtctctgtaactgtgtgtacagactgcttggcttgcatttcaggtcttcaaatcctttaagcttttctgaatgccacaaacttctctcttggctttttttctacttcccgtatacaactttacttagtaaacatccagtggtggttttgtctcttggggtctacagcacaatccaggattcacatcatgaatggcttctatggaactccttgcaggagctctcctgccacatcctgacctcagcagtttctcttatctttgagtaaatttcataccccatttactcttgtatcctggactgtaaatctagaaataacttggtaatattgccaattattattctctgtatggaataaaatcttccccctactgaattacttgtgtataaactttgattcatagatgtctttgtttaaaaatccttccttcattttagaagcagaatattccatagatactttcttttcacaagtcacaggatggacaaggggcctctttatgaattggaggtctgaagtgtgagctcttctcctgagaatatcttttcctttatataatttctccttatctcaatcatcacaaaccaaggtttggatatgatatttcttgtttttaaattttctcctttaaatgtgttttttgtattttacttgtcaattaagttcttttatttttcattgtatatactcaaatgtgatcatttctgccaaccatattagtccaaaacacttcacttccaggacctcagtagtcagtgtatccgcaagaggtctcttactcttgacattgggctttttttttaaccaatatgtcttttgaagagtcatcctctcttttaaaaatgtatcaattcaatagaggtatattcatgtaaagaagaaaataatatagaaatccattattcgtataataaaataatcaatgatattttgtattagtgaatacctaagataagtataaaatgacttgcttattgttctgtactaaggatttattatagtgctttgtaaatggctcatacccattttgctactaagttgagtatccctgggccttgttttactgaaacagtgtctaaacctggtccatgctggattttaactgagatttttttgctcctgtacctgagtactgggattagaattacacaccagtgtacccatgtaactttgtctttaataattatgccaaatttatgaatttgacataaagtatacagaatttctctgaatacttaatgaaaaatgctgctcatataacactacttaatttattcttttctttttaaatataattttattcattttcatttcaaataatatccccctttccagttaccaatccaccaaaccctcttttcatccctcatctccccactctactttgcctctatgagggtattcatccacttactaacccactcccacctcaccactctagcaaccccctacactaaggcattaagcctccacaggaccaagggcctccccttccactgatgtcaaataagtccatcctctgctacatatgtatctgaagtgttggattcctacatttatactctttggttggtggtttagtctctgggaactctaggtgttttgattacttgatattattcttcctatatggttgcagtccccttcaactcattcagtccttccactagctctttcattggggtccctgggttgagtccaatggttggttgttagtatctgtatctgtattgctaatgtgtcagtagaaattctcagggaacagtcatatcagacagctgttggcaagtgcttcttggcattatcaatagttttgggtttggtatctgcagatggaatacatctctaggtagagcagcctctggatggccttttctacagtctctgttccattgtttgtccatgtctttccttggacaggaaaattgctagatcaaaaattttgagattggagtgtgtccccatcccctaactgggggccatgcctatctacaggagctgtccactacaggttctagctcctctttgttgtgtatttctactaagtcttccctgttagattgtgagagcttctcacttgtctggcatgtgggattttttactgcctatccccagttccccatcccccactgctacatatttctatgtgattttctgaccctctttacttctttttattccttccaataactgattctgtcccatttttttcctccttcttctctctaacttgcagggcttgacctgcctttgcctcctgtgattattgtgttctcccatctatataagattcaagacaggaattttctgtgtaacagccattggtgaagtgaaacttacttttttgacgagactggcactgaattcacagaaatccaataccccctgcctcttgagtgctggggagaaaggtatgcactaccatacctgcctttaaattgctattttagatgatggctttatgctaattaagtttctgggaaatggaatattatagtcatcagttcatggaaagagcagtaataagggtagtataattaaggaaacattttaatactgcttgtgtgttgaataaatagtatgagtaaggaatatattttgatatcgttcatatgacatgtttttttcttttgtataatgtgaaattttaaatttatgtagcacactggtatagttataataagttgcaaactttatacaaatattttaaactatataaattcagttattgcacatatttcatcattataatctgttgtacatcaacagataacatttggacagcaattgcatatcgaaattagtttgtcattattttgttattgatattactttcacattatttatatcttttttccactggtagtatttttcccaagaattgttcaatgaaaactcttaaaataatgtattccttaatctcttactctttttcttagtagttccttttgttttactccataaactgtagtgaactctcagaataatgaaagaaaagcaacataaaataccttacagggaaataaggagacttgtaactatagtaattctggttgagggctcagtgaagacagtgcataaagggtcagctagcattttttttatttctgttttcatcaattagttctacagaccttactttcacttaattcttcctttgtgtattttatattggtgaattggcatactgtttatttgaagttcctaaatttattaattttgcaaaagttgtactccacgttttgtccataaatgttaaaaatgaaaaaatggacccagtttatactgttcattcattcaatgacttggatgaaattcagtgtttatctggtattttgccagtggtgctccatcattattcatcttagagaatcagaatgtttcccaagagacaggtaaaggaagctacaaacatgatgagcttaggaacttataaaatgtacaaattcacttcacatgaaatgttaaaagtaaaaactatttccataaatatcatatgactctgggtcatatgcccaaatgatattttgcctctatcatgctattatttaaaatttttgctaaatcccaattccaaagacaacccatgacatcatggaaagataatcatattataggactaaatgaatgaggaattaaatgattttaggatataaattatttcttttttacccctgagttctataggactcctcatttaaacttaacctacacctaaactctctcactaatggtagattttatttgttgttggcatgtttacaaatgtgtaaaattaaatgggtgtccctcttgcttacatttgtcaactaaaaaatctctttctctctctccgatagagaaatagagtgctatccttgtagcacaaatagaaacattcatccatattaatgaggaaaatacttgagtgttgaagcatactgtcatagccctctgttgctctaaccacagtcaattttaatgtcatgaaccattctgattttggcatatcagtcaacagtgtgcctgttaggagacaatgaccaggggaaataacaaaaattatatgttacatagttaaaactgctcccggtgtattctgatgcgtttgcattcttgataaactattaagtacaacatttatagaaaaccacagggaatattccctggaatataccatatctgcattcttccaggaaggacctaacttccctcagtggattataaaatcatattcatcgctgataaagttaagtaaggttaaaaactctgtttattggcacagagactatattcagtatccagaatgacctcttctgcaagaaatagtttgcagggacttttatagtcagcgatagtggtgcatatcaatacattgcacaaacactttgaaatgagtttatttagggatggtagtgaaagtctatttgtctcaacaatatatttcagtaagctaacaaactcgataaaaattataaaataaaatcctattttctaaaataactatgaaagcagaaaacaaaacttgctttttacctagaacatataaaacattctttctctttacccatagacagaatgttctccataagaaatcagaagtctagagtatatttaataaatttcttagtttcacaaatgtttcattaataaatgagtgaatttgaaaaatataaacatctaagcaaaaatatacaaatatatggaaactatgtatagtattacttctctcaatgtagaagtttattgtgagcagatatgtaaatgatagaaaaagggaagtttgattaacagaaatgcaagtaaaatcatatatagaatataagggcattgacatcacaatattggctattgaaaatatactgagttctatagtagcggcctcacggagagttgtacttttctcgtatctgacagagcatttaacaaaagggggggctggtaagatggctcatcaggtaagagcactggactgctcttctgaaggtcctgagttcaaatcccagcaaccacatggtggctcacaaccatccgtaacaagatctgactccctcttctggtgtgtctgaagacagctacagtgtacttacatataataaatactttaaaatctttaaaaaacaaacaaacaaaaaaccaaaaagggatggtataattaaatctatttattgaattaatggatcaatagtttggttgactaagttaaggtgacaagcagatttgtagaaagctgcttttgtcagtctcctttacttatgacctttgtgactttcaactagagaaattccatagatacaactatgatacttaacttcttaagacacaatgtctacttcagaccaattagaagtatacttcaaaaaatgccatatgtttatagatagattcattttgtttatgttctgtatacagaatcttacttctgtatgataatattgtcattatcattatatattgaggtattgccatgtgccatgtgtacaatattttcatacagtatctgttatcgttcccacctacatgtatttatgtatatcaatacatagtacagacccatttaactgagtgctcaagaatgagatagatatttggagattggcatgcattatgacatatatttgaatggtcttcattacaatggaaattacaagcttatttttgtattgctaatttttcctctccattttaaccccttctttagatgcattagtacttatatggttataaattgtttctacattctagtcagtgacaatatgacataccaaaaagtactaaaaatatacaatctgattttattatattcagggaagaaaatactggattaaaaataattaagttagtactattttctgagatgaaatttctttcatcttctacatatggctttcaatatcactctaccatataattttattacatacatacaattatatttcaattagatttccttgctaaaattttaagattgatagagacaagacaagtaactaacaattaccacatattactccagtttcaaacttgtttaaattataattttctacgttatttatgtttgtctctgtggtaaaagaggatgatctatgtcagacattgtcaacattaaaagatatgttgtgaaaaatgcactagaacaacctatgtagtttcaaatgtattccatatatgtttataaggagacacaaaaatgacagtaaagagattctaagagagtagaagaaaaattctagtttagggttgtatctgagtagtctttccagaagatttttggtgaaactacaaaattttggacatgaatttcaagaccattgcctatttcatggatcaagatagtgatctctctcgctctcccactcttactgtctgtctgtctctctgtgcatgtgtgtgttaagtttttttttttttttggttgtgtgtgtgtgtgtgtgtgtgtgtgtgatgacaccttttgtcctcacatgtaccatttaatagacagagaatatgcaatagcagtaatgattctggaggtcacacacctttaggaaacaaatcagatgatatgaaatattgtgataggggtttgttacctgcatttcaaggaggatccagaaatatatccattaaaccaaatatcacatctgtcttcaacatttcattgttacatttacatttgtagtattttgaacaatttcctattttttgaaatcagaggaacatttcttaacccatctgtggctttgtacactgcagacagtatcatgaattaacccttctttctgggctttcagtaaattatgaactaaagtgacataaggaaagaataaaacaatattgaattgcctttaaatgaatacagtttcagttcttaatcctatgactatttttttttacctttagagttatccaaagacatttttagagcagaaatcaatcagataaaatgagttgctattagatattgtaccaaaggaaggcagatgttcatgaagaaataacttttggtctgggttatacgtagtaactgatagaaatttattttataataaaataactgtctgagtttgtcaagtaatatagcttacttttcaaactagtgatcttcacatcaaagagttcacacaaaaacaaaatgagttatactcataatttcagtgaaaattagacatattcaagatgatagcctcaaatttatagttctttcaagttgtatgttttacatatattatttacctttaatccagcaattttcttagtttgatggtccctgaaactctctctttccaaagacaacatacttcttaaaatttctaagttgtaaatatctgttaattatttaagattgctcatgcttctttcatcaaaatattagttgattattaatccatagaaatcttttttatagacaagttaataatattcaataaagtacactctatcaagattagatagcatttgttctgaagtgtctctttcagattgaactttgtaaaagccatttagtgtacgactggggaaggatatatttagacatcttgctattagagataaaatggctgaatcaactgtaatgcttgacttagaacaattagcagtctagaatcacaattgataatcataaactcatagaattactttgtattacctcaaacaatggcatttaatttactggaagtcagtatatattcaagacactctctctcatgtcagctgtctttgaagccataggctcaaatgattctcctgcatcagcttccttagtagctaggaacacatacaattatctcactgtatttgtttggccatagcaactctgattattctatgaatttgagcttataacttttatttttttaaaaaactgaaaaattattgtaagtaggtttatattcgtatcttatggtgaaacaactttcaacctttaaatacaatattagtaaaattgtggtgtccaatactaaagatttgtttaaacaaaaaaaaaattctagatatttttctcctggttgagttgaaaatctccaataaaactttagtttattcctcaagtatattaaagaagttatatgttttaactctattgcagaaggtgcttatcaaatctgtttacaaatattcagtatttcctactatttaagttacttttactgtatgaccttttctctttaaatgcctttgtgctggtaacacacgcaaattacagcataagcagaataagcacatagaatataatattggttaatcccatacagcaaaattgactatgagcattagccaatatttctttgctatttacaatttcattttataattcaactgaatttttttagtgtcagtgttttaacagcagatttctcccaggaactctttgaaaactatgatgccaattacttttattttgtaataaactgtaggaaactctataaagatttaggcaataatgtaggttgacagtaagaactgaaagctaggataatttttttagaattctttagattatgctgaagtttacttttttatcaatgtttatttttataataaccacgtttttagacatatttagaacgttctttaattaacaaatcatccttgtgtgtttgcatatgtgtaaacatgtatgcatgtatgtgtacatgaaggagagaggtaaatgttaaatatttatctccatcataatttaccttgttttttttaagacagagtctctctctgaacttagtgttcacagtttcagctagcctggctaaccagtgaacctctgggatcctcttgtctctacatccttaggttgtatttacaggcttgtttcaccatacttgtctttacatgattcttggagaggatacctctggtactcctatttatgcaagaagcactttacctatggagttatatttctaattccaatgatcactaactgatacttccagatcaatagtccagctagtccaaacaaaatcaaggtcaatctggcttcatgctcagaattcaatgcctctaatgagtatacaggaacatagtaccatactccttatggtttatttcagtagtaaactctaccgcatcaaaattaagactgaaacatctgtcaatttgtagactgttccttttgaaatgtagaactatttgtatgttttccctttgaaatattcccttatatattctactacattcatagatttgaagcatatctgaacatctttggataattttgaggtttttgtacatagaaagaaggaggagacaatattccatctttggatatatatccagtttccagatcaccaatgattgaatagattcttctttctccaatatgtgttcctggtactttgtaaaaccaattgcttataaatattttgaaggttttgtacatatttccattctgtttcttttcttctgtggtcaggtcttctagaaatacgatgcttgatttatgtagctttagtatatattgggaagtgaggatttatgaaatgtttagatttatacttttagctcatgcttgctttgtctaattgaatcttttgtggttatgtgaattttctgattttttctattaaaataaaggttgtaattagtattttattgcaggtttcagtgaatctatagattgttatggggaaagaatatatattaactgtgcttttccaactcatgaacatgaggaaacttttcatgcttgagaattctatgtgaatttttcaaattatatagcttaatttagaaatatttaactttattgactaatttttgagtatttttgcgacatatatatatatatatactccattttctatgtgtaaaatgttatttttatataattagctcacaaagaaacacatgacttcatagcatttttcaaacactattttgtttgattcttccattcattttctctctttatccctcctttcagtactttattgatttgcttcaaatattggcctttctctttaatgtctcacatgtctaatattttttatatgttatggcttattctcttcctagatcttatattccctttcgtagtttttggtccttaaggaacattaattacacacacacacacatgtatatatatataaatatatatatatatatatatatatatatatatatatatatatatatatatatatctcaattagcatcaaggatcttcatttgagaaataatataaagtaaaggattttttagcctgactttttattttacaacttcactgaattagtgaggaaacaacctctaaattggaggacaatttttttttcaaaatgttaatctaacaaagcattaatatacacaatacacagaagacacaaacaaaaatcctcctcaacaacaaaagaatattctttactaaaatggacaaaagacactgctcataagtcattacaaaaataaatatttaaaaaatttttatttattttttatttgtcttttatttttctctttttttattaggtattttcctcgtttacatttccaatgctatcccaaaagtcccccatacccaccccctcaatcccttatgcacccactccccctttttggccctggcgttcccctgtactggggcatataaagtttgcaagtccaaagggcctctctttccagtgatggctgactaggccatcttttgatacatatgaagctagagacaagagctccggagtactggttagttcatattgttgttccacctatagggttgcagttccctttagctccttgggtactttctctagctcctccattgggggtcttgtgacccatccaatagctgactgtgatcatccacttctgtgtttgctaggccccggcatattctcacaagagacagctatatctgggtcctttcagcaaaattgtgctagtgtatgcaatggtgtcagcgtttggaagctgattatgggatggatccctgcatatggcaatcactagatggtccatccttttgtcacagctccaaattttgtctctgtaactcctttcatgggtgttttgttcccatttctaagaaggggcaaagtgtccacaatttggtcttcattcttcttgagtttcatgtgttttgcaaattgtatcttatatcttgggtatcctaagtttctgggctaatgtccacttatcagtgagtacatattgtgtgagttcctttgtgattgggttacctcactcaggatgatgccctccaggtccatccatttggctaggaatttcataaactcattctttttaatagctgagtagtactccattgtgtaaatgtaccacattttctgtatccattcctctgttgaggggcatctgggttctttccagcttctggctattataaataaggctgctatgaacatagtggagcatgtgtccttcttaccggttgggacatcttctggatatatgcccaggagaggtattgcgggatcctctggtagtactatgtccaattttctgaaaaactgccagattgatttccagagtggttgtacaagtttgcaatcccaccaacaatggaggagtgttcctctttctccacatcctcgccagcatctgctgtcacctgaatttttgatcttagccattctgacttgtgtgaggtggaatctcagggttgttttgatttgcatttccctgatgattaaggatgttgaacatttattcaggtgcttctcagccattcggtattcctcaggtgagaattctttgttcagctctgagccccattttttaatggggttatttgattttctggagtccaccttcttgagttctttatatatattggatattagtcccctatccgatttgggataggtaaagatcctttcccaatctgttggtggtctttttgttttattgacggtttaaaacccctaacttgggcaaaagaaaatgtaacccaaaatccaagtgtgatatggcttagtcaagttaaaattatacacctattcaagctcatgaaaaaccacttctcagcatggggagcaagtacaagcatgaaattcaaacctttatgtaaaaaatcattgccaattgatagacaatgtcaaaagaagagtcacttttatttaatgatatgacccctggtagatcaatcattcttcagtggtaagttacatatacacatcagtatgggcagcagagattggacctgaaatactgaaaaaaaaggagaatataaagttggattattagggacggggagtgtatatgtcagtacttggtaggtaggggtaaatataatcaaaatacatttcatgaaattcccaaagaactaataagaactaataagataaaatattttttgcagatcagaatgcattgtttattaatatgtttacagtagaaaataatgagatgaatgccactaagtgaagacattatgaaatatttgtgaaaacaggatattattagtgactttttctttactctgcctgttatgtaaaacaacataaaaagagtaattagaactaacattgaggattatattaggtttcctaatgttaaaagtttaaagatagaaacattgttgtattgccttctagagacaataaagtataaaataataaaatcagaactttcctaacataaattcttgagaaaactcattctttttcatgaaaaccatgaatagtctttgacattttgcgattgaacattgagccattctgctaccatagcatagcatgagtattgtgacatgtctatttgatttttctgggaaatgactttcaaaagcacagcaaacaaagcagtcataaaactcatgtatgtgccctccacttggacctcaggacagatggttgtgtcatttattagtcattcttacttcagaggaattccacagcatagcaaaatgaaagaaaaactccaaagaaagggaaaatagaggttttcctttgtggtataattttatgattctttagctaatggaattcaagaaaaccaaaactgtgcaacccacattttctctgttaatgaaaatctgagggagattacacacacacacacacacacacacacacacacacacacacacctaacaagctaatttctttatatactaaattaagtcctgtattaagttcttatataggcttctagtttgtcctatgggtgtataaaccctattcaactgtgacttataaaagatatctacacatagatagtttttccttggccaggaatgttagctgaatggtacagccctggcctagtatgcaaaaaggcccttggtttgatgttctgtatcacacagacagacatagacacacacatacacacagagagacactgaaacaaaggaaagaataaaatagcaaagaaagaaaagaaatagaattggcttggaacatacttcagttggaaaagtacttgtccaaatgtaaagagtactgtttgttccccagcacccacatcaggagccagacaagatggtggacattgtgtttccaattctgggaaattataagcaccaggatactggagcttctatcgaaccttcctagtctaatcagagatccagttcactggacgaaactaggtgctgcatccctcagaaacaacacttttggtttccacatgtatacatgcacacatgtatgtaatttcacatacacaaaaagcagcagcagaacaacaatggcagcaagaaacagcttttcctttcaggttctttgtccactcaggagttttggcttactcttgcagtcatctgtttctcctgcagtcttgctgtggtgttgtgccgataactttcctgggtctttactaggacctgcctgtttctacagtcacctgaaatacctcatgtttcccttaagtaccaaagaaaatgccaagtgctaactgtttagtgctctaagttttttttttttttttttcatttgattatctgggtcctagccatgttctctaatgcaagggattttgtgctgttcgattagctttccttcattgctaacgacacttactagttttcagagactagggtgttccttccaaatacataattggacacaattgaaagagatggtcacaaacattatgcagatttttgtgtaaaaagattcttttaggatttggtataattaatagaaatattgtgttgctatggaagtggatagatatcaaagttgttcacaaagtgaatgaatgagaatgattcagacaatgatctgctgcccagaatctaatcctttccaacatattagccaacagtactaagaaacgggaataaaggatgctcagaaaaatcctccagtttgcatattacaatgttttacagccaagaatcacagtaattgtctttgttttgttttgttttgatatcatagaacttgctcataagtattgcaaattattgattaattttatgggttttgctttaaaattcattacaaattttaaatgaaacccaccagtatctatcatgcctaacttttcatcctattccctagtcttcctatcagacttcatccttgtgttcatttatggctgactaaaccagccatctccattggttgctaatctgcatagaccaggggcagcacttctcattcatgtgagcagaatccacttatcccaggactgtattaagaagttactaaaggaattttatttgtttggtagaaaccatggtgaatgaatcatgaggatcaatttgactcaccaaaaatagttgttattattattattattatttcttcttcttcttcttcttcttcttcttcttcttcttcttcttcttcttcttcttcttcttcttcttcttcttcttcttcttcttcttcttcttgtcttcttcttgtcttctcgtcttcttcttcttcttcttcttcttctcctcctcctcctcctcctcctcctcctcctcctcctcctcctcctcctcctcttcttcttcttcttcttcttcttcttcttcttcttcttcttcttcttcttcttcttcctcctcttcttcctcttcctccacttctcctcctccttcaccttcctcctcctcgtcttcttcctcttcttccttctcttcctcttattataattattaaataaaatatgggtttctttctgcttttctttttattggatacttatttacatttcaatttatccagtttcctggtcccccaactcccctatgccgtcttacctcctccttcttttatgagggtgttctcccatccaaccacccactcctgccttccactatactagggcattaagccttcataggaccaagggcctcttctcccattgatgtcttacaaggcaatcctctgctacatatgtgactggaaccataagtccctccatgtgtacccttttgttggtgatttagtctctgggagctctgggggcatctggttggtagatattttgttcttcctatggggtttttaacaccttagccccttcagtcctttccttatttcctccactggggtccccatgctcagtccaatagcatccatacctgaattggacaggctccgtcagagcttcccaggagacagttatatcagacacttcatggcatcagcagtagcttctgggttttctgtctgcttatggcaaggatgcccccaatggaacagtatctggattgcctttcctccagtctctgcttcactctttgtccctgcattttctttaaacaagtacaattctgggagaaaatttgggagagggatgccatgcctatcctctatatttggcatttctacaggttttcccttccatttgttaggtatctcagctaaggtcatcgctcttgactcctgggaaactcttgcttccctggtatttggggctttatggtggattttgtatcatccacataaatattttctgtttggatcaagaaattaaaactattcctttcatgcacacacatccttcttctccttctcccccttgtgttccttgttctcttcctcctccttctcttcctcatcatccttctcttccttctccccatcttcatgatcattatcagacgaaatgtgaatagtaatgtagtgaatcacatgcaagatttaaaagaaaataaaatatttcctttttgataaaagcacttaaaatatttttttcatattagaagacaaaataagttcagtatactggaagaacaatggaaacatatttgaatttaactcagtaagactatctgtatctcattgttaacccacagagaacttgagacaaagaatatacaggctccatgatgtagccacactcaaacttgcagtcttagactgacattaaaaagatcactctgttaagattatttgatagtaaactttgtaaatcttacctaaacaatttttggacaacacaaacagaatttttagtcaatgtggtaatgaagcaaaattctgcaacatatattaactcttctttatgacagtattttttatatgtgggctcaaggtactataaggctaatggtaaaataagaatttttgtgtgttgacacagcaaagtgagaatttagaggaaaaaatcaaaggatctttgatatttttatgaataagtttatgaatgtgatctctctccccctccctccctcccctcccctccccttctctcttctctctctctctctctctctctctctctctctctctctctctctctctctctctctctctctctccagaaacttgatgatttttttgaatcagaataaacaaagatattcaaaaccaaaaccaaaacaggtgattccttctggtatgaaagtagagggtatcccagcagaagtattaacaatgatttttttgttagaatcttgaaagaaaatatgcatccctctatcctatgccatttcctgtatggcatttcaaatcaaatatcccattctgcgtagtccatcatctgggttctacttgtagcctaactttgtttattctgttcattccttttttttctttcatagttttagccatattcctcaaccgtttcaaccctataacatgagagagaaaagaaaaatagatagagctggcaggatggaatgtttatcttagaatacttcttattaattacaccatcaagtttatggtttaagtttgatctacactgttaggatatctaatttctcctatttgattcttcttcaccaattactacttaaaaactgcaccaatagcaatcatctaacaaccaatggcataccatccacaagaaaccaccctcaggttggagagatggctcagcagttaagagtactgactgctcttctgaaaggtcccaagttcaattcccaggaactatgtggtggctcacaaccatctgtaatgggatctgatgcattcttctgttgtgtgtctaaagacaactagagtgtacttgtataaatagtaacaaataaataatattttctttaaaaaaaagcctctcaggtccatagcattcatatatactcagaaaactccccaaattccacagtcacataattacaaatactgtttgcagcttgcaaaatcatgaccctactacagcagaaggcaaatcacatgcatttgctgtattcagtcttaagtatcccaatactccatatctgagaataaaatgaaaacacattcccatattattttgtctttttatatattcttacattattttgatgtttattagatattaactttatttacatttcaaatattgttggattttttttaatgaaaccaaaaatttcactagagagaactactgcttcatcttgttatctgatatacacatgtatatggtgacatgggcacctctttccaaacataaacattaaaagagtttagttaaagattatattcacctgcaaaaatttctgtgtatggccagcacattattcttagtcaaaatatctcagaatatcaaaattcaaaacccaaacaaagatcttaaagaaatccaataattccagctcctctaacaggtacaaactttaaccatccaattcctgttcaaaatactatgaatctcattttaaaaactattaatttcagttcgtcattacagatagaaatcaggaaaaaaaatgcttgcaagtggatatgtcaagaataaatatctggaataaagaaggtattaataacactaagaccaaaatataaatgaaagaattgtcaatgatgtattttaaacaactgtgatgaacatgattaggagtcagaattgaaaaggagaaaatattcttaaatacatgagttacatacatatagaaatgggaattttgataattaaaaatcaaaactagaaatattaaaccctgccagtgaaaggaaggtactaaataccaacattttccctcaaagatcaaggtacctaaacccaagaatggacatttacagagtattacccatatgtagtcataaattggcaaatttagatgctggaagagagatagttccttttctttagagatgctgtcctgaaagaatacctgtattggagtggttccttactctgtgaatgtataggcagcatgaagaagataggagatagtacattggaaagaaaagaacatgtggagattggaaggaattggaggtacaactagaaagtgtagaactgagtgggggtatattcaaataaaattacatgtgtttatgaaacagtcagctttagaaagacacaagggaacaaaacacccaaggaaggagttacagagacaaagtttggagctgagacgaaaggatgaaccatcaaaagactgtcatacccggggatccatcccataatcagcctccaaatgctgacacattgcatacactagcaggtttttgctgaaaggacccagatatggctgtctcttgtgagactatgccagggcctaacaaacacagaagtggatgctcacagttagctattggatggatcacagggcccccaatggaggagctagagaaagtgaccaaggagctaaagggatctgcaaccttataggtgcaacaacaatatgaactaaccagcccccccccccccaagctcgtgtctctacctacctagtcggccatcagtggagagagcccccttggtcgtgcaaactttatatgcctcagtacaggggaatgccagggccaaagagtgggagtgggtggttgggggagtgggtgggggagtgtatgggggacttttgggatagcattggaaatgtaaataaaataaatacctaataaataaaaaaagaaagacacaaatcataaagtattacaccaaaactgcatttaccattgtggggtaaacaaggtagacacacttatataaccaatttctgtcacttaaactactgaaattttttactttattgttatttaataaattctgaaatttagacaaattgaaaaggagaaaatattcttgaatacatgagttatatacatatagagatggaaattttgataattaaaaatcaaaactagaaatattaaaccctgccagtgaaaggaaggtactaaataccagcattttccctcaaagatcaagatgataacaaagtatcaaaataagttcactaatatgtataaaatgtctaactgcaaactgtagcttattctaggtaaaaatacttatcaccatttaaattatatcaacctatggtggggagaatagcaaaaaaaatattactaggttaaaaagagtatctgatgaaatctaatatttattagaaatataaagttagcaaataaatattttaaggcagtgttctccacttgataaaatagctacatagacaatatcctgatcacatcaaacataaaacctaggacactatagcaacttaacaaaaagggacaaaatagtatttctgatatttctttccaacatgtctttggaagtttaatgtagttcatgggttgagacagagaagtacggtttacaaattataatgaaagaaataaaactgtcctgcattgggtgaaatgactgcctttgataaagcactgaaatgaacttatgaaaaaaaaaagtcttcagagctagttactgaatgcatcaagacttaactatatgagcatcattcattttcattgttgtgttaatactaaaagtagcaatttaagagttttttgtaatgtgtttttgtgtgcttatgtgtgtgaatgtgcatgtgcgtgtgcgtgcgtgcgtgcgtgcgtgcgtgcgtgcgtgtgtgtgtgttgtggttgtgccacaacaaagattcagaggacaacttatggtggactttcccttgtaatatttggaatctgaagatcaaacttatgccatgaggcttggcaaaagtgtctctacctgctaatgtatcttatttgctcaaatgaacaccaatttaatttgtaaaatatttttgaaagctttgagactcagtcagtgtttagtcatctcttgttgtgagcttgtggggaagtaaaacaacatgttataaatggcctggtagaatatagcaccttgtatcatggctaggaaatagagaaatataagaagagaccaggtcatgctcctagtgacaaaactgtccatattagacccacctccaaatattactatcatatcatctttgatatcttattgaggagttactccactgattacataagagcacccaagatttattaacttctcagaagtctataatctgtaaaacaggactctaaattgaacacttcaggagtatatcagacttaaatggtaagatcagattattatacatatactagctgtttccttgcatgcaagtcatggattaatacaatgcagaaaatatttaaactagaaagaaactctagaataaaatataagtaatgaggtacaggatccatttttctctatacataaaaatataatgctcttgtgaaatgaattaaaagtctaaatgtgtatgtcagtattaatgaatttaaagagtcaatattatctatatgtatattgttcttgactcagtgttttcctatttaaaacaaaattccagcattgactgattaatttcaaagtttatatgaaaagacaaaagatctatcatagacagaaaaaaatactaaagtagatcacaagtttgtaaatgatttataagactttgctttcaccttttaattaaaacaatgtagaaatctaagtaatttagcactggcaaatatcataaatataatacagagcacatgggcccagaagtagaaagtgcatatctagtgactgaaggataggttttcaggtgatggtgatatacttaggcaaggtaatataactgtaatgcagtcattcaagaggtaaacactcctttgtgagtgagacaagtgaccataggtgtgtgggttcatttctggttcttcaattctgttccattgatcttcctggctgtctctgtacaaataccatgcagtattcctcagtaatagagcttgaggtcagggatagaacttccaccagaagttcttttattgttttgaatagtttttgctatcctggttttttttttattattccaaataaatttgcaaattgtgctttctaagtctattgagttggaattttgataggtattggactgaatcttgtataacacatctttcacttgcttggttagagtctcaccaaggaattttatgttatttgtgactactgtgaaggctgccatttccataatttctttcttagagtgtttatcatttcagtagaggaagcatactgatttgtttgagttaatatatttagccactttcatgaagttgtgtttcaggataaggagttctctggtggaatttttgtggtcacttaactacactatcatatcatctgcaaatagcaatattttgacttcttgaaaggatttgtaccccactgctgattgtgagggcatagagctatacagaattgaagcctgggaaaatgaaacacaaaggttttcagtgctgttagaggtactttaaaatgtgttttcagattggatctattgtaaaaagcataccattttttcagctcttttctgatcatttccagggcattctttgaaagaaattctaatgttagtcagagatattacatattcatgtttcctgttacactattcataacaccaaatatctagcagtagactagatattcatctactgaaatcataggaagaaaattttatttataagcatttgctaataactaagctataagattaaaattatgcaatatggggagttgatttaattgaaattggacagacacaatttcttaaaaacaaaaccatgtatacttaaaacaaaaggcatttgttacatctcatgagcacatataatctttctcatggtaaatattgatgattgctctaaccaaacaagagaaagatttgtatgacaagaacattaagtctctgaggaaagaaacaaagaagatctcagaagatgaacagatctcccatgatcatggattggcagaattaatattgttaaaatggccatgttaaaatacgttttcaatccaaaaaaaataggagaggaacaatgagaaagaacgaaagtaaatgagaagtaaacagagatgatataatacatgtttcataagataagcagactaaagacttctgcatgtgaaatagaaaagtgccatagatctgcattttaagaaatgattctatgtattttgaatacttttaaatgaacatgacatgttacagggcttctctaaatagtgcctgagaatttttttaaaaatcattttctttctataacaggcataagaaattcatcatactcataccaatctacacaagagtgagatcatggtaccacctacatattcatctataataaaaccaagaaaataagaaaatactttatatataaatatttgtttttatgaagccataaaacctaactatataatttgggggaaaaaaacttacatggaattgacgacacagaggaaaataatccagactcaaaaaaaaaaaaaaaaaaaaaaaaaaaaaaaccaccaccaccaccaccaccacaacaacaacaaaaagacacatttgatctctaatcatatcattgaattgaagtgtgtttgtcactggtttctgaactgaagaaaaaacaagagccatgaatatagacagtaaatatctgtttcagaaagtgaagagcttattcttgtttgtttgttttgttttgttttatcaaaacagggtttttctgtatagcactggctgtcctggaactcactttgtagaccaggctggcctcaaactcagaaatccgcctgcctctgcctcccaagtgctgggattaaaggtgtgtgccactgccgcccatcgaataacatattcataattacccataaaaatggcaaagaaaaaccgggctgggagatgagggagaggaacatggtgtcaagaattcaaacaaacgtggtattgctgaatatgatattactgtagcctaatataggatgctgaataaaacacattttagaaagaatgcttggcatttccaagcactaacaatattttcattttatgtgaaggaaattgtaaatcaagtgtttattagttattagtagtagtcatctcataatacagcaatttgatatttctgataattctttacaaacaaatgacaattgtttcactctggatctgatttagtaactctgtgtagagaatctttttaatttttattgccaagcagacaagttttctgaggttattcctgtctgtggaaatatttatgtgttgagagagggtttggctgtatggatgattacaacagtttgataatgctaagtgactcatgcaaatagaaatttgagttccaaaaagaaagtgttctgataagatcaatgaatatttatgagcctgggtatctcttatttttattcgtatcatataacagtgttgactggctttaaaatcttagtttttgagaaatgggtatcctcactatggcccaaatatgccctaatacttgctatatttcttttagttaatgaacactgtaaagaaattgcacagtgcacaaaaggaaataacaggtaaatgcagatgtcaaaaggatgaaacaaaaaatgtataaattctgaaaaatgcacttgcatgttcaatagcactgtctacaaaatatagcgttgtctgttgacagtgacaaagtgtaaggagcagatagtagggccctgtaccttaatacttaatattttctagaatcgtgtctttcattttttgctttgttttccatcaatatctggctacttaatgtggtgtgaggagcctttctactatattaatgtatgcttgccttgttgaaattcaagaaaagaagcatatcagtggatacgaatgaccattttgcatgaaaactatgcatgaaagattttataatatgctgaaaatatcaaaacatcacacacatcttaatttcttcataaaatatatttatattaggattattgtaattaaatctttattaatctttaactgttatttgtggtgtgtgcttcattttcattgaagtatgtgttattatttgcaggctcagtacattcattcagctttttgactggacatatttagaatccccaacctacttcaaacagtcaccttaatctgacacatgacatagatatacaaagaactaagtaacaaattgagcaagcaaattcacaaggaacataaataatgaagcagacataccaacattttcacctaagtatatcccagagctacatgcattctctttcaaatattaccagataatcaaagttttttttttttttttttttttttagtatagaatagagtttatttagggcatggggtggggagttaagacggtactagacatagaaaaagacatagatatatagagagtagagaagtagaagaatagaggccagcaatgagcatgtgaagagagaggtgggaagggaacggggagagaggagggaagggatgaggggacagagtgggagcaagaaaacaagagagaaaacaagcaaggagagatccagcagcccctccagatcatcaaaattaaataaaaactaatacgcttcatattttccttgaggaagtgataatacaatggttttacgacccttgatatgaagcatagaattaactcgtacataaagtaaaaatgatgcaagtgaaatagaagagggtatatttttcaagttgcgtagtggtgtacaatagtctcaataggaatttgtcaagaaatgcaaggaattaaagacaacagttcacatataattcttatgtaaatttctgggaaacaaatatggctcatggaagatgatgccagaggacatggactcctatttgagtttgaaagtgaatctttgatttcataattcataccataatgaaattgaaggtcatataagaatcacacactgacacaataaatatagaatgtattattactgaaggaaccagagagataaatgagaacagtttaatatttaacaaagaatatcatggttatggaaaggtatcaactcttttgcctactctattgactatgacgacaggaaaaaattttaaagggacacatctgatacacaatctctacttgaatgcaacttctatgatcttctctaagatagtaccttggtatcttctagtactatttaaagtctttgaataactgttttgtataaaattacattctttagaaaaaaagaacctttgcaagaaattcactgtagtgaaataaattcagcaaactttgttgatcataaaacatttctgtggattattattcaatattactggatattattcagtattcactttactgtccaactcaaatgttcagcttttatcatctttgttcttgtcattaaggagttcaaacaataaacttatagaaccactatttcttttttccttaagatccaacaattttttttttttattttttggcttttcgagtcaaggtttctctgtgtagccctggctgtcctggaactcactctgtagaccaggctggccttgaactcagaaatttgcctgcctctgcctcccaaatgctgggactaaaggggtgcaccaccatgcctggctaatttttattttctatactgccaagtcctgaactcaagtgatcagaggaacatcaaatatgtgtccatgatgtggtatctaaaacacagataaataatgataggcattcgtcctgagttccaaagccatgcatttcaaaatggtaccactgtgttttccctcctgcataattaccatgccactcgacttgtgttctctaactattttctagattttaaaaaagtatttcttcctataatttgagatgagaaattctctttgtgctatgatgcacctaaccctcaagagatttgaggccccagggagtggggaggtctggttgggtcaaagttatggacaacctcttggagacaggaactgtctgagggcagactgtgagggggataacaactgtactgtaaaagtgtttgatgatgatgatgatgatgatgatgatgatgatgatacagaaattagttaaaaaaaagagtaaaatgacttccagaataaaaaaaaaagtgaagttttatatacattttttccatttataaatccctgaaactgcaacagtgtaatttcaggaaaacaatttcaggaattgataatacagagacaggcaatctaaattcaaaaataaaaataaaattactggttatgtttttctttatttgagcttattaggtgtacttagatgtattgatatagtctcacctctggtttcagtctagaaagaacaggaacaacacattgaatgatgatcaggaaacatatgtttctgaattgatttcagtattggtaattggagaatgaaataaaaataaataaaactgagtaagtggtggagaaagggatcatgtaaagtaggaatgtataaaaacaaaagtattgatgagtatgaatctattaaacttaccaacttaagctgctaattaaaagaaagcttaaaatgaaacaatgatatttgcgattaatgacaatatttttaaattatatcaagaaaaatagattttagaacaaaactttaatacagttaaatcttcttttttctttttttttatttgtgattgtctcacgatagagtatttttgataccttatttacatttgattaggataaatgtataaaagacaatgtattcatgatgactcttattgaattcttttattcatatactgggaaacatatcttctatacaaccatgtgtttctattttacagctgaggtgacaaggttttatttttttttccattttttattaggtatttaactcatttacatttccaatgctataccaaaagtcccccatatccacccacccccactcccctgcccacccactccccctttttggccctggaattcccctgtactggggcatataaagtttgcaagtccaatgggcctctctttccagtgatggccgactaggccatcttttgatatatatgcagctagagtcaagagctccagggtactggttagctcataatgttgttccacctatagggttgcagatccctttagctccttggctactttctctagctcctccattgggagccctatgatccatccattagctgactgtgagcatccacttctgtgttgtgacaaggttttatatggtggtaaaatatttatgcgttgaaagaggacttatctatatcaataaagaaaacaactgttttaggggtctgcacaactttcaaatggcaaactcattttcagatagaaagttctccaataataatagtgcagtttttagagtctggttgtactttttattgttcattgatgacacataacaataaagattgactttagaatcctatattttgagaaaataggcaatattacaatgtctcagaggtgacctaatacttgctttgttaatttatattgatcatttccataattaatagtatagtgtaaacatataattaaatgtgtcacaaatgcagaccttaaaaggatagataaaaatgggatgaaatcccaggaaaaaatatttactaggtcactaacattgttacccaaaagtggatttgctatgaagctgaaggtacataacaaatggtagatttccaagccttgctccagaaggatatttaaagactgtatttcttcttcttcctcctcttcttcttcttcttcttcttcttcttcttcttcttcttcttcttcttcttcttcttcttcttcttcttcttcttcttcttcttcttcttccccttcctcctcgtcctcctcctcctcctcctcctcctcctcctcctccttcttcttcttttttaatctcaaggcttttatcaatggttttctatgtaggcagtgtgagaaaaaaaatttctctatataaggacaattggcttcctttgtttgggaaggaatggattctgatcgctatctttttgtccatcatagctgacctatacagctctcaaaatttgaacaatttctcaacctctttttcgtatgtccatgtcttcttcagataatatttttaagttagtcattgtcataaaagttatttctgtcttgaaccatcattttttgtattacacattcattgtattacattatttttgtaagtttagtgtattttttgtcaattttcatagttaaacctagaaattgcaacctaattgtgacaaattcttgaacttgacttaaaatttagagaaatatattcctgaaaataaactatataaacagatgcacaaattttcttaaataatcaaaatttcaaactagatatgccttcccttcataatattctaggaatatcaatgttcagctgaaacaaacaaattgctgaatagtcccttagtgagaaaccaaaggaatgttttaagaattttgaaaggaagtatagactgatcacatgcccaaagcaaagtttcatgcaagataaacacaatactttttccaacgttaagtatatctaggaaagtgatgtacaataagaaattgtcaagagttcaagatcttaactcagttatcactccttgtatataaaataccttcatttttgacatatccaagtgagttaaataatatgaagcaacatttttaccttctcatagaaatattataatgccagaaaaccctaaatcccatcaattcataaagttgggaatttgttttatcctataacataatgcaaatacttgattatgaggttagataaacccacataataaccttagtatgtgatatacctcaagttaaccacatacacaacacagaaaaaaatcaatgtgttccaaataacatgtcttatgacaattggctgtattatattttaagtatatccctcatatcattgatttctgttgaatttatatcagtaaaatgtgttgatttttctacattaaattagtgtagcatatttttttgaaagtttccttatctggagtattacatttactgtttttcatatactaaacattttcatctcttgtatgatgaacacactggatggggataaatgatatttttatctgttcatggattcagtttataggtacttaattgatcacatttatatcaatgttcatgaagaaaattcatctgcaagtatgttatttttcagttccttatatggttcagatatcaaggtaaccatggccttatgaaaagaatatggatatataacttctctttctattttatgggaagtatgaggagaattagtattaactttctttgaacatttgggaggatgtgtactaaatatatttggatattcttttttttttttggaatgggaaggattcttttgatagctattcctatttcactatctgatcttaacagatatttggtaagtgacaaccactgaatgaattatctgcttcctttatattttcccattcagtggatttgaaattccttcttgtcttttatgtaagtcttgtcttttatgcttttcatatggactttgttaaagcagatatactctcaccatcttttggtgtgttggataattgtctttaattcttgtttattttctcaaagaaccaattattttattcattatttctttataatgttccacttgcttctagtaaatggatgtcaagccgctttctttgtttcctgttctctactgcacttgaatatacttgatttttcttgttcaatagattctagaggtattgttgtgttgctagcatgagggcattccaatttctatgaaatcaaacaaggctggcctccagttttgcaaagatttaaggaatttgttcaactcagataattcttttgttataattttgacctatttctcatggatagaagaggatgccaatttcagaatttggaggtctcatactttgatgcttacaaagccatggcgaataggtaaaggatgtcaacacaggcctccagggtcatttgggactcttcatttggcctgttaaaggaggcctatgggacagagccttccttagagagagaaaagtattttatgatatagaaccgtgctggctccacaggatgtgttcacaaagggcaatcactggagcaatattccaaacatctcacgctataggtaatttacctatatggatagggtgagatttttattgttgctatgggacccactaccttccaaaattccttcacaatattgcttagggctctcactgaacttcactgcagaatcaatgaggaaacaaaggtttacacattaggttgacacagggaaggaaggggtaaagaaattccactctgattcatgacaacaatgcacaatttggaacaagcaacagtattaacattcaccttatagaggctggaaacacattaatccaaataaatggatcaatggttagctatttgtactgagtactgagccgaggattctcaagatatttaaggaatcaaaatcacagtgagtgctgccatgaaacactgctaggctaaggtcaattgtgatgtggctattgcttcgagactaagcagtaaatctttattggaatgccagagctctttgtgcttccactgatgtttctctatggtagccaggaaaacatgtgtgtgctgggctggtagtaatacaagaggcaaccacaggagagtttctgcacaaggaagttgtgccaatagagcttcagaaaattgtctcacacctctgacatttatttagagaagggacaaccggtgccttcacttcttccctttcctccttagggaaaacatactttcaagtatcaaaaaagggtgcccttgcttccatctaaaatatttcgaccctgcaaccctctccagttacatgtgaccattcctaactctgaagcaattttggaaaggaaggtaagtgtttggtttaggttaggtgatatccaagtacaggtagccgtatactgtctaggcctgggtcaatgatgacaacccaatgtcatgaagaggggtgatgaaataaaattcatgctcaataggattatgctgaggcccaactagggtgacagggacacaagaggtccgttgactctatggggcgctcataagtgacgtccctgagatcctcagatgtccttgcttgttttcccatgagaggaaatggggacatctagggtgcacattggttggcaaacactgcatcccaacaagcacctagtccaacaatggaaatttgggcatttctgcatggatcacctcttgctcatgacaatgtcttttctggtgttttgcagtcatctcacatgcctactgtgaaggcagagaaccacagataatcaggtaagtggtaagaacatggtaaagccaccacctccaggtgacctgacccttatagttttggctttcaattctgagccagtctacccttttggaatttggggttaacaaaattggatgcaatggtaccaaacgaagctcgatttaggttatgttctcaagtgtagaccccctggtttttgaagttttaaggaatgtgctcaactcccagtaatggttttctcataattttgacctacttctcatggagagagggcgatgacattttaagaagatagaaggattctatgatatccaacaaggcttgcctccacatgatgtgttccaaagggcaatttctccagcaaatattccaaaaaactcaccacagagaaaatttacccatgtggatagggtgagattttcatttttaccttggttcccaccaactcccgaattaccaaattacaggggaggcccaagctacagagcctttcttagaaaaaaagaaggattctatgatatccaaaaaggctgtcctccacaggatgggttcacaaaaaaaaaatccctctagcagagtgttgatacctacaaaattgtgaggctaaggtcacatgtgatgtggctgttgcttcgagaagaagcagtaaatctttattggaatgccagggttcctttgtgtgtccactgatgtttctctatggtagccaggaagacttgtgtgtgctggcctggtagtaatacaaaatgtaaacccaggactgtttctgcaaaatgaaattgtgccagtagagctccagaaaaatgtctctctcctctgacctttatttaaagaaggtactacatgcgccttgacttctttccctttccgccttagggaagacattcttccaagtatcaagaaagggagcccttgcttccctggaaggcatttcgtcccagcaatccctctccagttccatgtgaccattcctactctgagccagttttggaaaggaaggtaagtgtttggattaggttaggtgatatccaagtagatgtagccgaattctgtctaggactgggtcaatgatgacaacccaatgtcatgaagaaaggtgatgacataaaattcatgctcaataggattacgctgaggcccaaccaggacgacagggtcacaagaggtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgccccttactcatgacaatgtcttttctggtgttttgcagtcatctcacatgccaccttggaaggcagagaaacacatataatcaggtaagtggtcagaacatggtaaagcctccacatccaggtgacctcccccttcatgatttggctttcaattctcagccagtcggtccttttggaattagggataacaaaatggtatgcaacggttccaaaggtgctcgatttaggctctgttctcccatgtagatcccctggtttataaagcttcaaggaatgtgttcaactccagataattgttttgaataattttgacctacttctcatggagagaggaggatgatattttttgaatgttgggatctcatactttgatgcttacaattccatggcaaatatctacaggaggacagcacagaactcccgggccttatggtatgcttcctttcccttgaaaggggaggccgaagtgacagtgccttttttagggaaaaagaaggattctatgatatccaaaaggctgtcctccccaggatgggttcaaaatgggcaatccctctagcagatattccaaagatctcaccccagagacaatttacccatgtggataagtgagatattaatttttaccttggtgcccaccacattccaaatttccttcatggtatcatttagggcacttactgaacctcactgcagaatcactgaggaaaaaaagctctacacattaggttgatacagggtaaggccaggtgtttaaagaacctaattccactttgattcataacaccaagtcctgacttgagtccagcaacagtggttaccctcacgttttacagcagggcaacccataacaccttgacacaaatggatccatgtatagacatgggttctgtggcctgggccaaggattctcaggagatttttaggaatcacctttcacgttgagtagggtagtacaacatagaccttaaagaggtctgatgccacatttgcactttgagcaaaaacacacagttacattattcaccctcgaaatacctatctgtagttgttttatttaaattttttttatcctatccatagaacttgggcagctcaacttgagtgttgatacctacaaaattgtgaggctaaggtcacatgtgatgtggctgttgcttcgagaggaagtagtaaaactttattggaatgccagggttcctttgtgtgtccactaatgtttctttatggtagccaggaatacttgtgtgtgctgggctggtagtaatacaaaatgtaaccccaggactgtttctgcaaaatgaagttgtgccagtagagctccagaaaaatgtctctctcctctgacctttatttaaagaagggactacaaacgccttgacttctttccctttcctccttagggaagacattcttccaagtatcaagaaagggagcccttgcttccctggaagacatttcgtcccagcaatccctctccagttccatgtgaccattcctactctgagccagttttggaaaggaaggtaagtggttggattaggttaggtgatatccaagtagatgtagccgaattctgtctaggactgggtcaatgatgacaacccaatgtcatgaagaaaggtgatgacataaaattcatgctcaataggattacgctgaggcccaaccagggtaacagggtcacagaggtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaattagggataacaaaatggtatacaactgtaccaaaggagctcgatttaggctatgttctccgatgtacatctcctggtttgtaacgttttaaggaatgtgttcaactcccgataattgttttttcataattttgacctacttctcatggagagaggaggatgacattttttgaatgttgggatctcatactttgatgcttacaattccatggcaaatatctacaggaggacagcacagaactcccgggccttatggtatgcttcctttcccttgaaaggggaggccgaagtgacagtgccttttttagggaaaaagaaggattctatgatatccaaaaggctgtcctccccaggatgggttcaaaaagggcaatccctctagcagatattccaaagatctcaccccagagacaatttacccatgtggataagtgagatattaatttttaccttggtgcccaccacattccaaatttccttcatggtatcatttagggcacttactgaacctcactgcagaatcactgaggaaaaaaagctctacacattaggttgatacagggtaaggccaggtgtttaaagaacctaattccactttgattcataacaccaagtcctgacttgagtccagcaacagtggttaccctcacgttttacagcagggcaacccataacaccttgacacaaatggatccatgtatagacatgggttctgtggcctgggccaaggattctcaggagatttttaggaatcacctttcacgttgagtagggtagtacaacatagaccttaaagaggtctgatgccacatttgcactttgagcaaaaacacacagttacattattcaccctcgaaatacctatctgtagttgttttatttaaattttttttatcctatccatagaacttgggcagctcaacttgagtgttgatacctacaaaattgtgaggctaaggtcacatgtgatgtggctgttgcttcgagaggaagtagtaaaactttattggaatgccagggttcctttgtgtgtccactaatgtttctttatggtagccaggaatacttgtgtgtgctgggctggtagtaatacaaaatgtaaccccaggactgtttctgcaaaatgaagttgtgccagtagagctccagaaaaatgtctctctcctctgacctttatttaaagaagggactacaaacgccttgacttctttccctttcctccttagggaagacattcttccaagtatcaagaaagggagcccttgcttccctggaagacatttcgtcccagcaatccctctccagttccatgtgaccattcctactctgagccagttttggaaaggaaggtaagtggttggattaggttaggtgatatccaagtagatgtagccgaattctgtctaggactgggtcaatgatgacaacccaatgtcatgaagaaaggtgatgacataaaattcatgctcaataggattacgctgaggcccaaccagggtaacagggtcacagaggtccgttgactccttggggggctctagggtgacttccctgaagtcgtcagatgcccttgccctgtttcccatgagaggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaattagggataacaaaatggtatacaacggtaccaaaggagctcgatttaggctatgttctccgatgtacatctcctggtttgtaacgttttaaggaatgtgttcaactcccgataattgttttttcataattttgacctacttctcatggagagaggaggatgacattttttgaatgttgggatctcatactttgatgcttacaattttatggcaaatagctaaaggaggacaacactggcctccagggccttatggtactcttcctttcccttgacaggggaggcccaagtgacagatcctttcttagggaaaaagaaggattctatgatatccaaaaaggctgtcctccccaggatgggttcacaaagggcaatccctctagcagatattccaaagatctcaccccagagacaatttaccaatgtggatagggtgagatattcatttttaccttggtgcccaccacattccaaatttccttcatggtatcatttagggcacttactgaacctcactgcagaatcactgaggaaaaaaagctctacacattaggttgatacagggtaaggccaggtgtttaaagaacctaattcctcattgattcataacaccaaggcctgactttagtccagcaacagtgcttacactcacgttttacagcagggcaacccataacacgttgacacaaatggatacatgtatagacatgggttctgtggcctcggtccaggattctccggagattttcaggaatcacctttcacgttgattcgggtcgtaaaacatagaccttacagaggtctgatgccacatttgcactttgagcaaaaacacacagttactttaatcaccctcgaaatacctatctgtagttgttttattcagttatttttttgtcctatccatagaacttgggcagctcaacttgagtgttgatacctacaaaatggtgaggctaaggtcacctgtgatgtggctgttgcttcgagaggaagcagtaaatctttattggaatgccagggttcctttgtgtgtccaatgatgtttctctatggtagccaggaagacttgtgtgtgctgggctggtagtaatacaagaggtaaccccagggcagtttatgcacaatgaagttgtacaagtagagctccagaaaaatgtctctcttctctggcctttatttaaagaagggacaacaagcaccttgacttctttccctttcctccttagggaagacattcttccaagtatcaagaaagggagcccttgcttccctggaagacatttcgtcccagcaatccctctccatgtccatgtgaacattcctactctgagccagttttggaaaggaaggtaagtggttggattaggttaggtgatatccaagtagaggtagccgaattctgtctaggactgggtcaatgatgacaacccaatgtcatgaagaaaggtgatgacataaaattcatgctcaataggattacgctgaggcccaaccagggcgacagggtcacaagaagtccgatgacaccttggggggctcttgggtgaattccctgaagtccttagatgcccttgccctgtttcccgtgagaggaaatgtggacatctagggtgcacattggttggcaaaaactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtctgttcttttgcaatttggggataacaaaatggtatgcaacggttccaaaggtgctcgatttaggctatgttctcccatgtagatcccctggtttgtaaagctttaaggaatgtgttcaactcccgataattgtttttgaataattttgacgtacttctcatggagagaggaggatgatattttttgaatgttgggatctcatactttgatgcttacaattccatggcaaatatctataggaggacagcacagaactcccgggccttatggtatgcttcctttcccttgaaaggggaggccgaagtgacagtgcctttttttagggaaaaaagaaggattctatgatatccaaaaggctgtcctccccaggaagggttcacaaagggcaatccctctagcagatattccaaagatctcacgccagagacaatttacccatgtggatagggtgagctattcatttttaccttggtgcccaccacattccaaatttccttcatggtatcatttagggcacttactgaacctcactgcagaatcactgaggaaaaaaagctctacacattaggttgatacagggtaaggccaggtgtttaaagaacctaattccactttgaatcataacaccaagtcctgacttgagtccagcaacaatggttaccctcacgttttacagcagggcaacccataacaccttgacacaaatggattcatgtatagacatgggttctgtggcctgggcccaggattctcaggagatttttaggaatcacctttcacgttgagtagggtagtacaacatagaacttaaagaggtctaatgccacatttgcactttgagcaaaaacacacagttactttattcaccctcgaaatacctatctgtagttgttttatttaaattttttttatcctatccatagaacttgggcagctcaacttgagtgttgatacctacaaaattgtgaggctaaggtcacatgtgatgtggctgttgcttcgagaggaattagtaaaactttattggaatgccagggttcctttgtgtgtccactaatgtttcctatggtagccaggaatacttgtgtgtgctgggctggtagtaatacaaaatgtaaccccaggactgtttctgcaaaatgaagttgtgccagtagagctccagaaaaatgtctctctcctcggacctttatttaaagaagggactacaagcgccttgacgtctttccctttcctccttagggaagacattcttccaagtatcaagaaagggagcccttgcttccctggaagacatttcctcccagcaatccctctccagttccatgtgaccattcctactctgagccagttttggaaaggaaggtaagtggttggattaggttaggtgatatccaagtagaggtagccgaattctgtctaggactgggtcaatgatgacaacccaatgtcatgaagaaaggtgatgacataaaattcatgctcaataggattaccctgaggaccaaccaggttaacagggtcacagaggtccgttgactccttggggggctctagggtgacttccctgaagtcctcagatgccctttccctgtttcccatgagaggaaatgtggacatctagggtgcacattggttggcaaaaactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagagcatggtaaagcctccacatccaggtgaccacccccttcatgatttggctttcaattctcagccagtcggtccttttggaattagggattacaaaatggtatacaacggtaccaaaggagctcgatttaggctatgttctccgatgtacatctcctggtttgtaacgttttaaggaatgtgttcaactcccgataattgttttttcataattttgacctacttctcatggagagaggaggatgacattttttgaatgttgggatctcatactttgatgcttacaattttatggcaaatagctaaaggaggacaacactggcctccagggtcttatggtactcttcctttcccttgacaggggaggcccaagtgacagatcctttcttagggaaaaagaaggattctatgatatccaaaaaggctgtcctccccaggatgggttcaaaaagggcaatccctctagcagatattccaaagatctcaccccagagacaatttaccaatgtggatagggtgagatattcatttttaccttggtacccaccacattccaaatttccttcatggtatcatttagggcacttactgaacctcactgcagaatcactgaggaaaaaaagttctacacattaggttgatacagggtaaggccaggtgtttaaagaacctaattccacattgattcataacaccaaggcctgactttagtccagcaacagtgcttatactcacgttttacagcagggcaacccataacacgttgaaacaaatggatacatgtatagacatgggttctgtggcctcggtccaggattctccggagattttcaggaatcacctttcacattgagtcgggtcgtaaaacatagaccttacagagttctgatgccacatttgcactttgagcaaaaacacacagttactttaatcaccctcgaaatacctatctgtagttgttttattcagttatttttttgtcctatccatagaacttgggcagctcaacttgagtgttgatacctacaagatggtgaggctaaggtcacctgtgatgtggctgttgcttcgagaggaagcagtaaatctttattggaatgccagggttcctttgtgtgtccactgatgtttctctatggtagccaggaagacttgtgtgtgctgggctggtagtaatacaagaggtaaccccagggcagtttatgcacaatgaagttgtacaagtagagctccagaaaaatgtctctctcctctggcctttatttaaagaaaggacaacaagcgccttgacttctttccctttcctccttagggaagacattcttccaagtatcaagaaagggatcccttgcttccctggaagacatttcatcccagcaatccctctccatgtccatgtgaacattcctactctgagccagttttggaaaggaaggtaagtgtttggattaggttaggtgatatccaagtagaggtagccgaattctgtctaggactgggtcaatgatgacaacccaatgtcatgaagaaaggtgatgacataaaattcatgctcaataggattacgctgaggcccaaccagggcgacagggtcacaagaagtccgttgacaccttggggggctcttgggtgaattccctgaagtccttagatgcccttgccctgtttcccgtgagaggaaatgtggacatctagggtgcacattggttggcaaacactgcatgccaacaagcacctagtcccacaatggaaccttgggcatttctgcaaggatcgccccttgctcatgagaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtctgttcttttgcaatttggggataacaaaatggtatgcaacggttccaaaggtgctcgatttaggctatgttctcccatgtagatcccctggtttgtaaagctttaaggaatgtgttcaactcccgataattgtttttgaataattttgacgtacttctcatggagagaggaggatgatattttttgaatgttgggatctcatactttgatgcttacaattccatggcaaatatctataggaggacagcacagaactcccgggccttatggtatgcttcctttcccttgaaaggggaggccgaagtgacagtgcctttttttagggaaaaaagaaggattctatgatatccaaaaggctgtcctccccaggaagggttcacaaagggcaatccctctagcagatattccaaagatctcacgccagagacaatttacccatgtggatagggtgagctattcatttttaccttggtgcccaccacattccaaatttccttcatggtatcatttagggcacttactgaacctcactgcagaatcactgaggaaaaaaagctctacacattaggttgatacagggtaaggccaggtgtttaaagaacctaattccactttgaatcataacaccaagtcctgacttgagtccagcaacaatggttaccctcacgttttacagcagggcaacccataacaccttgacacaaatggattcatgtatagacatgggttctgtggcctgggcccaggattctcaggagatttttaggaatcacctttcacgttgagtagggtagtacaacatagaccttaaagaggtctaatgccacatttgcactttgagcaaaaacacacagttactttattcaccctcgaaatacctatctgtagttgttttatttaaattttttttatcctatccatagaacttgggcagctcaacttgagtgttgatacctacaaaattgtgaggctaaggtcacatgtgatgtggctgttgcttcgagaggaattagtaaaactttattggaatgccagggttcctttgtgtgtccactaatgtttcctatggtagccaggaatacttgtgtgtgctgggctggtagtaatacaaaatgtaaccccaggactgtttctgcaaaatgaagttgtgccagtagagctccagaaaaatgtctctctcctcggacctttatttaaagaagggactacaagcgccttgacgtctttccctttcctccttagggaagacattcttccaagtatcaagaaagggagcccttgcttccctggaagacatttcctcccagcaatccctctccagttccatgtgaccattcctactctgagccagttttggaaaggaaggtaagtggttggattaggttaggtgatatccaagtagaggtagccgaattctgtctaggactgggtcaatgatgacaacccaatgtcatgaagaaaggtgatgacataaaattcatgctcaataggattaccctgaggaccaaccaggttaacagggtcacagaggtccgttgactccttggggggctctagggtgacttccctgaagtcctcagatgccctttccctgtttcccatgagaggaaatgtggacatctagggtgcacattggttggcaaaaactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagagcatggtaaagcctccacatccaggtgaccacccccttcatgatttggctttcaattctcagccagtcggtccttttggaattagggataacaaaatggtatacaacggtaccaaaggagctcgatttaggctatgttctccgatgtacatctcctggtttgtaacgttttaaggaatgtgttcaactcccgataattgttttttcataattttgacctacttctcatggagagaggaggatgacattttttgaatgttgggatctcatactttgatgcttacaattttatggcaaatagctaaaggaggacaacactggcctccagggtcttatggtactcttcctttcccttgacaggggaggcccaagtgacagatcctttcttagggaaaaagaaggattctatgatatccaaaaaggctgtcctccccaggatgggttcaaaaagggcaatccctctagcagatattccaaagatctcaccccagagacaatttaccaatgtggatagggtgagatattcatttttaccttggtacccaccacattccaaatttccttcatggtatcatttagggcacttactgaacctcactgcagaatcactgaggaaaaaaagttctacacattaggttgatacagggtaaggccaggtgtttaaagaacctaattccacattgattcataacaccaaggcctgactttagtccagcaacagtgcttatactcacgttttacagcagggcaacccataacacgttgaaacaaatggatacatgtatagacatgggttctgtggcctcggtccaggattctccggagattttcaggaatcacctttcacattgagtcgggtcgtaaaacatagaccttacagagttctgatgccacatttgcactttgagcaaaaacacacagttactttaatcaccctcgaaatacctatctgtagttgttttattcagttatttttttgtcctatccatagaacttgggcagctcaacttgagtgttgatacctacaagatggtgaggctaaggtcacctgtgatgtggctgttgcttcgagaggaagcagtaaatctttattggaatgccagggttcctttgtgtgtccactgatgtttctctatggtagccaggaagacttgtgtgtgctgggctggtagtaatacaagaggtaaccccagggcagtttatgcacaatgaagttgtacaagtagagctccagaaaaatgtctctctcctctggcctttatttaaagaaaggacaacaagcgccttgacttctttccctttcctccttagggaagacattcttccaagtatcaagaaagggatcccttgcttccctggaagacatttcatcccagcaatccctctccatgtccatgtgaacattcctactctgagccagttttggaaaggaaggtaagtgtttggattaggttaggtgatatccaagtagaggtagccgaattctgtctaggactgggtcaatgatgacaacccaatgtcatgaagaaaggtgatgacataaaattcatgctcaataggattacgctgaggcccaaccagggcgacagggtcacaagaagtccgttgacaccttggggggctcttgggtgaattccctgaagtccttagatgcccttgccctgtttcccgtgagaggaaatgtggacatctagggtgcacattggttggcaaacactgcatgccaacaagcacctagtcccacaatggaaccttgggcatttctgcaaggatcgccccttgctcatgagaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtctgttcttttgcaatttggggataacaaaatggtatgcaacggttccaaaggtgctcgatttaggctatgttctcccatgtagatcccctggtttgtaaagctttaaggaatgtgttcaactcccgataattgtttttgaataattttgacgtacttctcatggagagaggaggatgatattttttgaatgttgggatctcatactttgatgcttacaattccatggcaaatatctataggaggacagcacagaactcccgggccttatggtatgcttcctttcccttgaaaggggaggccgaagtgacagtgcctttttttagggaaaaagaaggattctatgatatccaaaaggctgtcctccccaggaagggttcacaaagggcaatccctctagcagatattccaaagatctcaccccagagacaatttacccatgtggatagggtgagatattcatttttaccttggtgccaaccacattccaaatttccttcatggtatcatttagggcacttactgaacctcactgcagaatcactgaggaaaaaaagctctacacattaggttgatacagggtaaggccaggtgtttaaagaacctaattccactttgattcataacaccaagtcctgacttgagtccagcaacagtggttaccctcacgttttacagcagggcaatccataacaccttgacacaaatggatccatgtatagacatgggttctgtggcctgggcccaggattctcaggagatttttaggaatcacctttcacgttgagtagggtagtacaacatagaccttaaagaggtctgatgccatatttgcactttgagcaaaaacacacagttactttattcaccctcgaaatacctatctgtagttgttttatttaaatttttttttatcctatccatagaacttgggcagctcaacttgagtgttgatacctacaaaattgtgaggctaaggtcacatgtgatgtggctgttgcttcgagaggaagtagtcaaactttattggaatgacagggttcctttgtgtgtccactaatgtttctctatggtagccaggaagacttgtgtgtgctgggctggtagtaatacaaaatgtaaccccaggactgtttctgcaaaatgaagttgtgccagtagagctccagaaaaatgtctctctcctcggaccttatttaaagaagggactacaagcgccttgacttctttccctttcctccttagggaagacattcttccaagtatcaagaaagggagcccttgcttccctggaagacatttcgtcccagcaatccctctccagttccctgtaaccattcctactctgagccagttttggaaaggaaggtaagtggttggattaggttaggtgatatccaagtagatgtagccgaattctgtctaggactgggtcaatgatgacaacccaatgtcatgaacaaaggtgatgacataaaattcatgctcaataggattacgctgaggcccaaccaggttaacagggtcacagaggtccgttgactccttggggggctctagggtgacttccctgaagtcctcagatgccctttccctgtttcccatgagaggaaatgtggacatctagggtgcacattggttggcaaaaactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaattagggataacaaaatggtatacaacggtaccaaaggtgctcgatttagtctatgttctccgatgtacatctcctggtttgtaaagttttaaggaatgtgttcaactcccgataattgttttttcataattttgacctacttctcatggagagaggaggatgacattttttgaatgttgggatctcatactttgatgcttacaattttatggcaaatagctaaaggaggacaacactggcctccagggccttatggtactcttcctttcccttgacaggggaggcccaagtgacagatcctttcttagggaaaaagaaggattctatgatatccaaaaaggctgtcctccccaagatgggttcacaaagggcaatccctctagcagatattccaaagatctcaccccagatacaatttaccaatgtggatagggtgagatattcatttttaccttggtacccaccacattccaaatttccttcatggtatcatttagggcacttactgaacctcactgcagaatcactgaggaaaaaaagctctacacattaggttgatacagggtaaggccaggtgtttaaagaacctaattccacattgattcataacaccaaggcctgactttagtccagcaacagtgcttatactcacgttttacagcagggcaacccataacacgttgacacaaatggatacatgtatatacatgggttctgtggcctcggtccaggattctccggagattttcaggaatcacctttcacgttgagtcgggtcgtaaaacatagaccttacagaggtctgatgccacatttgcactttgagcaaaaacacacagttactttaatcaccctcgaaatacctatctgtagttgttttattcagttatttttttgtcctttccatagaacttgggcagctcaacttgagtgttgatacctacaaaatggtgaggctaaggtcacctgtgatgtggctgttgcttcgagaggaagcagtaaatctttattggaatgccagggttcctttgtgtgtccactgatgtttctctatggtagccaggaagacttgtgtgtgctgggctggtagtaatacaagaggtaaccccagggcagtttatgcacaatgaagttgtacaagtagagctccagaaaaatgtctctctcctctggcctttatttacagaagggacaacaagcgccttgacttctttccctttcctccttagggaagacattcttccaagtatcaagaaagggagcccttgcttccctggaagacatttcctcccagcaatccctctccagttccatgtgaccattcctactctgagccagttttggaaaggaaggtaagtggttggattaggttaggtgatatccaagtagaggtagccaaattctgtccaggactgggtcaatgatgacaacccaatatcatgaagaaaggtgatgacataaaattcatgctcaataggattacgctgaggcccaaccagggcgacagggtcacaagaagtccgttgacaccttggggggctcttgggtgaattccctgaagtccttagatgccctttccctgtttcccgtgagaggaaatgtggacatctagggtgcacattggttggcaaacactgcatgccaacaagcacctagtcccacaatggaaccttgggcatttctgcaaggatcgccccttgctcatgataatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtctgttcttttgcaatttggggataacaaaatggtatgcaacggttccaaaggtgctcgatttaggctatgttctcccatgtagatcccctggtttgtaaagctttaaggaatgtgttcaactcccgataattgtttttgaataattttgacgtacttctcatggagagaggaggatgatattttttgaatgttgggatctcatactttgatgcttacaattccatggcaaatatctacaggaggacagcacagaactcccgggccttatggtatgcttcttttcccttgaaaggggaggccgaagtgacagtgcctttttttagggaaaaagaaggattctatgatatccaaaaggctgtcctccccaggaagggttcacaaagggcaatccctctagcagatattccaaagatctcaccccagagacaatttaccaatgtggatagggtgagatattcatttttaccttggtgcccaccacattccaaatttccttcatggtatcatttagggcacttactgaacctcactgcagaatcactgaggaaaaaaagctctacacattaggttgatacagggtaaggccaggtgtttaaagaacctaattccactttgattcataacaccaagtcctgacttgagtccagcaacagtgcttacactcacgttttacagcagggcaacccataacacgttgacacaaatggatacatgtatagacatgggttctgtggcctgggtccaggattctcgggagattttcaggaatcaactgtcacgttgagtcgggtcctacaacatagaccttacagaggtctgatgccacatttgcactttgagcaaaaacacacagttactttaatcaccctcgaaatacctatctgtagttgttttattcaattattttttgtcctatccatagaacttgggcagctcaacttgagtgttgatacctacaaaatggtgaggctaaggtcacctgtgatgtggctgttgcttcgagaggaagcagtaaatctttattggaatgccagggttccgttgtgtgtccactgatgtttctctatggtagccaggaagacttgtgtatgctgggctggtagtaatacaagaggtaaccccaggacagtttctgcacaatgaagttgtacaagtagagctccagaaaaatgtttctctcctcggacctttatttaaagaagggactacaagagccttgacttctttccctttcctccttagggaagacattcttccaagtatcaagaaagggagcccttgcttccctggaagatatttcgtcccagcaatccctctccagttccatgtgaccattcctactctgagccagttttggaaaggaaggtaagtggttggattaggttaggtgatatccaagtagaggtagccgaattctgtctaggactgggtcaatgatgacaacccaatgtcatgaagaaaggtgatgacataaaattcatgctcaataggattaccctgaggcccaaccagggtaacagggtcacagaggtccgttgactccttggggggctctagggtgacttccctgaagtcctcagatgccctttccctgtttcccatgagaggaaatgtggacatctagggtgcacattggttggcaaaaactgcatgccaacaagcacctagtcccacaatggaaccttgggcatttctgcaaggatcgccccttgctcatgacaatgtcttttctggtgttttgcagtcatctcacatgccacctggaaggcagagaaacacagataatcaggtaagtggtcagaacatggtaaagcctccacatccaggtgacctcccccttcatgatttggctttcaattctcagccagtcgttccttttggaattagggataacaaaatggtatacaacggtaccaaaggagctcgatttaggctatgtttttagatgtacatcccctggtttgtaacgttttaaggaatgtgttcaactcccgataattgttttttcataattttgacctacttctcatggagagaggagaatgacattttttgaatgttgggatctcatatttgatgcttacaattttatggcaaatagctacaggaggacaacactggcctccagggccttatggtactcttcctttcccttgacaggggaggcccaagtgacagatcctttcttagggaaaaagaaggattccatgatatccaaaaaggctgtcctccccaggatgggttcacaaagggcaatccctctagcagatattccaaagatctcaccccagagacaatttaccaatgtggatagggtgagatattcatttttaccttggtacccaccacattgcaaatttccttcatggtatcatttagggcacttactgaacctcactgcagaatcactgaggaaaaaaagctctacacattaggttgatacagggtaaggccaggtgtttaaagaacctaattccacattgattcataacaccaaggcctgactttagtccagcaacagtgcttatactcacgttttacagcagggcaacccataacacgttgacacaaatggatacatgtatagacatgggttctgtggcctcggtccaggattctccaaagattttcaggaatcacctttcacgttgagtcgggtcgtacaacatagaccttacagaggtctgatgccacatttgcactttgagcaaaatcacacagttactttaatcaccctcgaaatacctatctgtagttgttttattcagttatttttttgtcctatccatagaacttgggcagctcaacttgattgttgatacctacaaaatggtgaggctaaggtcacctgtgatgtggctgttgcttcgagaggaagcagtaaatctttattggaatgccagggttcctttgtgtgtccactgatgtttctctatggtagccaggaagacttgtgtgtgctgggctggtagtaatacaagaggtaaccccaggacagtttctgcacaatgaagttgtacaagtagagctccagaaaattgtctctcccctctgaccattatttaaagaagggacaacaagcgactcgacttctttccctttcctccttagggaagacattcttccaagtatcaagaaagggagcccttgcttccctggaagacatttcgtcccagcaatccctctcaagttccatgtgaccattcctactctgagccagttttggaaaggaaggtaagtggttggattaggttaggtgatatccaagtagatgtagccgaattctgtctaggactgggtcaatgatgacaacccaatgtcatgaagaaaggtgatgacataaaattcatgctcaataggattacgctgaggcccaaccagggcgacagggtcacaagaggtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatgaaaccttgggcatttctgcaaggatcgccccacgctcatgacaatgtcttttctggtgttttgcagtcatctcacatgccaccttggaaggcagagaaacacagataatcaggtaagtggtcagaacatggtaaatcctccacatccaggtgacctcccccttcatgatttggctttcaattctcagccagtcggtccttttggaattagggataacaaaatggtatacaacggtaccaaaggagctcgatttaggctatgttctccgatgtacatcccctggtttgtaaggttttaaggaatgtgttcaactcccgataattgttttttcataattttgacctacttctcatggagagaggaggatgacattttttgaatgttgggatctcatactttgatgcttacaattttatggcaaatagctacaggaggacatcactggcctccagggccttatggtactcttcctttcccttgacaggggaggcccaagtgacagatcctttcttagggaaaaagaaggattctatgatatccaaaaagtctgtcctccccaggatgggttcacaaagggcaatccctctagcagatattccaaagatctcaccccagagacaatttaccaatgtggatagggtgagatattcatttttaccttggtacccaccacattgcaaatttccttcctggtatcatttagggcacttactgaacctcactgcagaatcactgaggaaaaaaagctctacacattaggttgatacagggtaaggccaggtgtttaaagaacctaattccactttgattcataacaccaaggcctgactttagtccagcaacagtgcttacactcacgttttacagcagggcaacccataacacgttgacacaaatggatacatgtatagacatgggttctgtggcctgggtccaggattctcgggagattttcaggaatcacctgtcacgttgagtcgggtcctacaacatagaccttacagaggtctgatgccacatttgcactttgagcaaaaacacacagttactttaatcaccctcgaaatacctatctgtagttgttttattcaattattttttgtcctatccatagaacttgggcagctcaacttgagtgttgatacctacaaaatggtgaggctaaggtcacctgtgatgtggctgttgcttcgagaggaagcagtaaatctttattggaatgccagggttccgttgtgtgtccactgatgtttctctatggtagccaggaagacttgtgtatgctgggctggtagtaatacaagaggtaaccccaggacagtttctgcacaatgaagttgtacaagtagagctccagaaaaatgtctctctcctctgacctttattaaagaagggacaacaagcgtcttgacttctttccctttcctccttagggaagacattcttccaagtatcaagaaagggagcccttgcttccctggaagacatttcgtcccagcaatccctctccagttccctgtaaccattcctactctgagccagttttggaaaggaaggtaagtggttggattaggttaggtgatatccaagtagatgtagccgaattctgtctaggactgggtcaatgatgacaacccaatgtcatgaagaaaggtgatgacataaaattcatgctcaataggattacgctgaggcccaaccaggttaacagggtcacagaggtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcaccccttgctcatgacaatgtcttttctggtgttttgcagtcatctcacatgccaccttggaaggcagagaaacacagataatcaggtaagtggtcagaacatggtaaagcctccacatccagttgacctcccccttcatgatttggctttcaattctcagccagtcggtccttttggaattagggataacaaaatggtatacaacggtaccaaaggagctcgatttaggctatgttctccgatgtacatcccctggtttgtaacattttaaggaatgtcttcaactcccgataattgttttttcataattttgacctacttctcatggagagaggaggatgacattttttgaatgttgggatctcatactttgatgcttacaatttcattgcaaatagctacaggaggacaacactggcctccagggccttatggtactcttcctttcccttgacaggggaggcccaagtgacagatcctttcttagggaaaaacaaggattctatgatatccaaaaaggctgtcctccccaagatgggttcacaaagggcaatccctctagcagatattccaaagatctcaccccagagacaatttaccaatgtggatagggtgagatattcatttttaccttggtgcccaccacattccaaatttccttcatggtatcatttagggcacttactgaacctcactgcagaaagactgaggaaaaaaagctctacacattaggttgatacagggtaaggccaggtgtttaaagaacctaattccactttgattcataacaccaaggcctgactttagtccagcaacagtgcttacactcacgttttacagcagggcaacccataacaggttgacacaaatggatacatgtatagacatgggttctgtggcctcggtccaggattctcgggagattttcaggaatcacctttcacgttgagtcgggtcctacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgattgttgatacctacaaaatggtgaggctaaggtcacctgtgatgtggctgttgcttcgagaggaagcagtaaatctttattggaatgccagggttccgttgtgtgtccactaatgtttctctatggtagccaggaagacttgtgtatgctgggctggtggtaatacaagaggtaaccccaggacagtttctgcacaatgaagttgtacaagtagagctccagaaaaatgtctctctcctctgacctttatttaaagaagggacaacaagcgtcttgactactttccctttcctccttagggaagacattcttccaagtatcaagaaagggagcccttgcttccctggaagacatttcctcccagcaatccctctccagttccatgtgaccattcctactctgagccagttttggaaaggaaggtaagtggttggattaggttaggtgatatccaagtagatgtagccgaattctgtctaggactgggtcaatgatgacaacccaatgtcatgaacaaaggtgatgacataaaattcatgctcaataggattacgctgaggcccaaccagggcgacagggtcacaagacgtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcaccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaattagggataacaaaatggtatacaacggtaccaaaggagctcgatttaggctatgttctccgatgtacatcccctggtttgtaacggtttaaggaatgtcttcaactcccgataattgttttttcataattttgacctacttctcatggagagaggaggatgacattttttgaatgttgggatctcatactttgatgcttacaatttcattgcaaatagctacaggacgacaacactggcctccagggccttatggtactcttcctttcccttgacaggggaggcccaagtgacagatcctttcttagggaaaaacaaggattctatgatatccaaaaaggctgtcctccccaagatgggttcacaaagggcaatccctctagcagatattccaaagatctcaccccagagacaatttaccaatgtggatagggtgagatattcatttttaccttggtgcccaccacattccaaatttccttcatggtatcatttagggcacttactgaacctcactgcagaatcactgaggaaaagaagctctacacattaggttgatacagggtaaggccaggtgtttaaagaacctaattccactttgattcataacaccaaggcctgactttagtccagcaacagtgcttacactcacgttttacagcagggcaacccataacaggttgacacaaatggatacatgtatagacatgggttctgtggcctcggtccaggattctcgggagattttcaggaatcacctttcacgttgagtcgggtcctacaacatagaccttacagaggcctgatgccacatttgcactttgagcaaaaacacacagttactttaatcaccctcgaaatacctatctgtaattgttttattcaattatttttttgtcctatccatagaacttgggcagctcaacttgattgttgatacctacaaaatggtgaggctaaggtcacctgtgatgtggctgttgcttcgagaggaagcagtaaatctttattggaatgccagggttccgttgtgtgtccactaatgtttctctatggtagccagcaagacttgtgtatgctgggctggtggtaatacaagaggtaaccccaggacagtttctgcacaatgaagttgtacaagtagagctccagaaaaatgtctctctcctctgacctttatttaaagaagggacaacaagcgtcttgactactttccctttcctccttagggaagacattcttccaagtatcaagaaagggagcccttgcttccctggaagacatttcctcccagcaatccctctccagttccatgtgaccattcctactctgagccagttttggaaaggaaggtaagtggttggattaggttaggtgatatccaagtagatgtagccgaattctgtctaggactgggtcaatgatgacaacccaatgtcatgaacaaaggtgatgacataaaattcatgctcaataggattacgctgaggcccaaccagggcgacagggtcacaagacgtccgttgactccttggggggctctagggtgacttccctgaagtcctcagatgcccttgccctgtttcccatgagaggaaatgtggacatctagggtgcacattggttggcaaacactgcatgccaataagcacctagtcccacaatggaaccttgggcatttctgcaaggatctccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaattagggataacaaaatggtatacaacggtaccaaaggagctcgatttaggctatgttctccgatgtacatcccctggtttgtaacggtttaaggaatgtcttcaactcccgataattgttttttcataattttgacctacttctcatggagagaggaggatgacattttttgaatgttgggatctcatactttgatgcttacaatttcattgcaaatagctacaggacgacaacactggcctccagggccttatggtactcttcctttcccttgacaggggaggcccaagtgacagatcctttcttagggaaaaacaaggattctatgatatccaaaaaggctgtcctccccaagatgggttcacaaagggcaatccctctagcagatattccaaagatctcaccccagagacaatttaccaatgtggatagggtgagatattcatttttaccttggtgcccaccacattccaaatttccttcatggtatcatttagggcacttactgaacctcactgcagaatcactgaggaaaaaaagctctacacattaggttgatacagggtaaggccagggtgtttaaagaacctaattccactttgatttcataccaccaaggcctgactttattccagcaacagtgcttacactcacgttttacagcagggcaacccataacaggttgacacaaatggatacatgtatagacatgggttctgtggcctcggtccaggattctcgggagattttcaggaatcacctttcacgttgagtcgggtcctacaacatagaccttacagaggtctgatgccacatttgcactttgagcaaaaacacacagttactttaatcaccctcgaaatacctatctgtaattgttttattcaattatttttttgtcctatccatagaacttgggaagctcaacttgattgttgatacctacaaaatggtgaggctaaggtcacctgtgatgtggctgttgcttcgagaggaagcagtaaatctttattggaatgccagggttccgttgtgtgtccactaatgtttctctatggtagccagcaagacttgtgtatgctgggctggtggtaatacaagaggtaaccccaggacagtttctgcacaatgaagttgtacaagtagagctccagaaaaatgtctctctcctctgacctttatttaaagaagggacaacaagcgtcttgactactttccctttcctccttagggaagacattcttccaagtatcaagaaagggagcccttgcttccctggaagacatttcctcccagcaatccctctccagttccatgtgaccattcctactctgagccagttttggaaaggaaggtaagtggttggattaggttaggtgatatccaagtagatgtagccgaattctgtctaggactgggtcaatgatgacaacccaatgtcatgaacaaaggtgatgacataaaattcatgctcaataggattacgctgaggcccaaccagggcgacagggtcacaagacgtccgttgactccttggggggctctagggtgacttccctgaagtcctcagatgcccttgccctgtttcccatgagaggaaatgtggacatctagggtgcacattggttggcaaacactgcatgccaataagcacctagtcccacaatggaaccttgggcatttctgcaaggatctccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaattagggataacaaaatggtatacaacggtaccaaaggagctcgatttaggctatgttctccgatgtacatcccctggtttgtaacggtttaaggaatgtcttcaactcccgataattgttttttcataattttgacctacttctcatggagagaggaggatgacattttttgaatgttgggatctcatactttgatgcttacaatttcattgcaaatagctacaggacgacaacactggcctccagggccttatggtactcttcctttcccttgacaggggaggcccaagtgacagatcctttcttagggaaaaacaaggattctatgatatccaaaaaggctgtcctccccaagatgggttcacaaagggcaatccctctagcagatattccaaagatctcaccccagagacaatttaccaatgtggatagggtgagatattcatttttaccttggtgcccaccacattccaaatttccttcatggtatcatttagggcacttactgaacctcactgcagaatcactgaggaaaaaaagctctacacattaggttgatacagggtaaggccaggtgtttaaagaacctaattccactttgattcataacaccaaggcctgactttagtccagcaacagtgcttacactcacgttttacagcagggcaacccataacaggttgacacaaatggatacatgtatagacatgggttctgtggcctcggtccaggattctcgggagattttcaggaatcacctttcacgttgagtcgggtcctacaacatagaccttacagaggtctgatgccacatttgcactttgagcaaaaacacacagttactttaatcaccctcgaaatacctatctgtaattgttttattcaattatttttttgtcctatccatagaacttgggcagctcaacttgattgttgatacctacaaaatggtgaggctaaggtcacctgtgatgtggctgttgcttcgagaggaagcagtaaatctttattggaatgccagggttccgttgtgtgtccactgatgtttctctatggtagccaggaagacttgtgtatgctgggctggtggtaatacaagaggtaaccccaggacagtttctgcacaatgaagttgtacaagtagagctccagaaaaatgtctctctcctctgacctttatttaaagaagggacaacaagcgtcttgactactttccctttcctccttagggaagacattcttccaagtatcaagaaagggagcccttgcttccctggaagacatttcctcccagcaatccctctccagttccatgtgaccattcctactctgagccagttttggaaaggaaggtaagtggttggattaggttaggtgatatccaagtagatgtagccgaattctgtctaggactgggtcaatgatgacaacccaatgtcatgaacaaaggtgatgacataaaattcatgctcaataggattacgctgaggcccaaccagggcgacagggtcacaagacgtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcattcctgcaaggatcaccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaattagggataacacaatggtatacaacagtaccaaaggagctggatttaggctatgttctccgatgtacatcccctggtttgtaacgttttaaggaatgtgttcaactccagataattgttttttcataattttgacctacttctcatggagagaggaggatgacagtttttgaatgttgggatctcatactttgatgcttacaattttatggcaaatagctacaggaggacaacactggcctccagggccttatggtactcttcctttcccttgacaggggaggcccaagtgacagatcctttcttagggaaaaacaaggattctatgatatccaaaaaggctgtcctccccaggatgggttcacaaagggcaatccctctagaagatattccaaagatctcaccccagagacaatttaccaatgtggatagggtgagatattcatttttaccttggtgcccaccacattccaaatttccttcatggtatcatttagggcacttactgaacctcactgcagaatcactgaggaaaaaaagctctacacattaggttgatacacggtaaggccaggtgtttaaagaacctaattccactttgattcataacaccaaggcctgactttagtccagcaacagtgcttacactcacgttttacagcagggcaacccataacacgttgacacaaatggatacatgtatagacatgggttctgtggcctccgtccaggattctcgggagattttcaggaatcacctttcacgttgagtcgggtcctacaacatagaccttacagaggtctgatgccacatttgcactttgagcaaaaacacacagttactttaatcaccctcgaaatacctatctgtagttgttttattcaattattttttgtcctatccatagaacttgggcagctcaacttgagtgttgatacctacaaaatggtgaggctaaggtcacctgtgatgtggctgttgcttcgagaggaagcagtaaatctttattggaatgccagggttccgttgtgtgtccactgatgtttctctatggtagccaggaagacttgtgtatgctgggctggtagtaatacaagaggtaaccccaggacagtttctgcacaatgaagttgtacaagtagagctccagaaaaatgtctctctcctctgacctttattaaagaagggacaacaagcgtcttgacttctttccctttcctccttagggaagacattcttccaagtatcaagaaagggagcccttgcttccctggaagacatttcctcccagcaatccctctccagttccatgtgaccattcctactctgagccagttttggaaaggaaggtaagtggttggattaggttaggtgatatccaagtagatgtagccgaattctgtctaggactgggtcaatgatgacaacccaatgtcatgaacaaaggtgatgacataaaattcatgctcaataggattacgctgaggcccaaccagggcgacagggtcacaagaggtccgttgactccttggggggctctagggtgacttccctgaagtcctcagatgcccttgccctgtttcccatgagaggaaatgtggacatctagggtgcacattggttggcaaacactgcatgccaacaagcacctagtcgcacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaattagggataacaaaatggtatacaacggtaccaaaggagctcgatttaggctatgttctccgatgtacatcccctggtttgtaacgttttaaggaatgtcttcaactcacgataattgttttttcataattttgacctacttctcatggagagaggaggatgacattttttgaatgttgggatctcatactttgatgcttacaatttcattgcaaatagctacaggaggacaacactggcctccagggccttatggtactcttcctttcccttgacaggggaggcccaagtgacagatcctttcttagggaaaaacaaggattctatgatatccaaaaaggctgtcctccccaagatgggttcacaaagggcaatccctctagcagatattccaaagatctcaccccagagacaatttaccaatgtggatagggtgagatattcatttttaccttggtgcccaccacattccaaatttccttcatggtatcatttagggcacttactgaacctcgctgcagaatcactgaggaaaaaaagctctacacattaggttgatacagggtaaggccaggtgtttaaagaacctaattccactttgattcataacaccaaggcctgactttagtccagcaacagtgcttacactcacgttttacagcagggcaacccataacaggttgacacaaatggatacatgtatagacatgggttctgtggcctcggtccaggattctcgggagattttcaggaatcactgttcacgttgagtcgggtcctacaacatagaccttacagaggtctgatgccacatttgcactttgagcaaaaacacacagttactttaatcaccctcgaaatacctatctgtaattgttttattcaattatttttttgtcctatccatagaacttgggcagctcaacttgattgttgatacctacaaaatggtgaggctaaggtcacctgtgatgtggctgttgcttcgagaggaagcagtaaatctttattggaatgccagggttccgttgtgtgtccactaatgtttctctatggtagccaggaagacttgtgtatgctgggctggtggtaatacaagaggtaaccccaggacagtttctgcacaatgaagttgtacaagtagagctccagaaaaatgtctctctcctctgacctttatttaaagaagggacaacaagcgtcttgactactttccctttcctccttagggaagacattcttccaagtatcaaaaaagggagcccttgcttccctggaagacatttcctcccagcaatccctctccagttccatgtgaccattcctactctgagccagttttggaaaggaaggtaagtggttggattaggttaggtgatatccaagtagatgtagccgaattctgtctaggactgggtcaatgatgacaacccaatgtcatgaacaaaggtgatgacataaaattcatgctcaataggattacgctgaggcccaaccagggcgacagggtcacaagacgtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcattcctgcaaggatcaccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaattagggataacacaatggtatacaacagtaccaaaggagctcgatttaggctatgttctccgatgtacatcccctggtttgtaacgttttaaggaatgtgttcaactcccgataattgttttttcataattttgacctacttctcatggagagaggaggatgacattttttgaatgttgggatctcatactttgatgcttacaattttatggcaaatagctacaggaggacaacactggcctccagggccttatggtactcttcctttcccttgacaggggaggcccaagtgacagatcctttcttagggaaaaagaaggattctatgatatccaaaaaggctgtcctccccaggatgggttcacaaagggcaatccctctagcagatattccaaagatctcaccccagagacaatttaccaatgtggatagggtgagatattcatttttaccttggtgcccaccacattccaaatttccttcatggtatcatttagggcacttactgaacctcgctgcagaatcactgaggaaaaaaagctctacacattaggttgatacagggtaaggccaggtgtttaaagaacctaattccactttgattcataacaccaaggcctgactttagtccagcaacagtgcttacactcacgttttacagcagggcaacccataacaggttgacacaaatggatacatgtatagacatgggttctgtggcctcggtccaggattctcgggagattttcaggaatcactgttcacgttgagtcgggtcctacaacatagaccttacagaggtctgatgccacatttgcactttgagcaaaaacacacagttactttaatcaccctcgaaatacctatctgtaattgttttattcaattatttttttgtcctatccatagaacttgggcagctcaacttgattgttgatacctacaaaatggtgaggctaaggtcacctgtgatgtggctgttgcttcgagaggaagcagtaaatctttattggaatgccagggttccgttgtgtgtccactaatgtttctctatggtagccaggaagacttgtgtatgctgggctggtggtaatacaagaggtaaccccaggacagtttctgcacaatgaagttgtacaagtagagctccagaaaaatgtctctctcctctgacctttatttaaagaagggacaacaagcgtcttgactactttccctttcctccttagggaagacattcttccaagtatcaaaaaagggagcccttgcttccctggaagacatttcctcccagcaatccctctccagttccatgtgaccattcctactctgagccagttttggaaaggaaggtaagtggttggattaggttaggtgatatccaagtagatgtagccgaattctgtctaggactgggtcaatgatgacaacccaatgtcatgaacaaagtgatgacataaaattcatgctcaataggattaggctgaggcccaaccagggcgacagggtcacaagacgtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaattagggataacaaaatggtatacaacggtaccaaaggagctcgatttaggctatgttctccgatgtacatcccctggtttgtaacggtttaaggaatgtcttcaactcccgataattgttttttcataattttgacctacttctcatggagagaggaggatgacattttttgaatgttgggatctcatactttgatgcttacaatttcattgcaaatagctacaggaggacaacactggcctccagggccttatggtactcttcctttcccttgacaggggaggcccaagtgacagatcctttcttagggaaaaacaaggattctatgatatccaaaaaggctgtcctccccacgatgtgttcacaaagggcaatccctctagcagatattccaaagatctcaccccagagacaatttaccaatgtggatagggtgagatattcatttttaccttggtgcccaccacattccaaatttccttcatggtatcatttagggcacttactgaacctcactgcagaatcactgaggaaaaaaagctctacacattaggttgatacagggtaaggccaggtgtttaaagaacctaattccactttgattcataacaccaaggcctgactttagtccagcaacagtgcttactctcacgttttacagcagggcaacccataacaggttgacacaaatggatacatgtatagacatgggttctgtggcctcggtccaggattctcgggagattttcaggaatcacctttcacgttgagtcgggtcctacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgattgttgatacctacaaaatggtgaggctaaggtcacctgtgatgtggctgttgcttcgagaggaagcagtaaatctttattggaatgccagggttccgttttgtgtccactgatgtttctctatggtagccaggaagacttgtgtatgctgggctggtggtaatacaagaggtaaccccaggacagtttctgcacaatgaagttgtacaagtagagctccagaaaaatgtctctctcctctgacctttatttaaagaagggacaacaagcgtcttgactactttccctttcctccttagggaagacattcttccaagtatcaaaaaagggagcccttgcttccctggaagacatttcctcccagcaatccctctccagttccatgtgaccattcctactctgagccagttttggaaaggaaggtaagtggttggattaggttaggtgatatccaagtagatgtagccgaattctgtctaggactgggtcaatgatgacaacccaatgtcatgaacaaaggtgatgacataaaattcatgctcaataggattacgctgaggcccaaccagggcgacagggtcacaagacgtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaattagggataacaaaatggtatacaacggtaccaaaggagctcgatttaggctatgttctccgatgtacatcccctggtttgtaacggtttaaggaatgtcttcaactcccgataattgttttttcataattttgacctacttctcatggagagaggaggatgacattttttgaatgttgggatctcatactttgatgcttacaatttcattgcaaatagctacaggacgacaacactggcctccagggccttatggtactcttcctttcccttgacaggggaggcccaagtgacagatcctttcttagggaaaaacaaggattctatgatatccaaaaaggctgtcctccccaagatgggttcacaaagggcaatccctctagcagatattccaaagatctcaccccagagacaatttaccaatgtggatagggtgagatattcatttttaccttggtgcccaccacattccaaatttccttcatggtatcatttagggcacttactgaacctcactgcagaatcactgaggaaaaaaagctctacacattaggttgatacagggtaaggccaggtgtttaaagaacctaattccactttgattcataacaccaaggcctgactttagtccagcaacagtgcttacactcacgttttacagcagggcaacccataacaggttgacacaaatggatacatgtatagacatgggttctgtggcctcggtccaggattctcgggagattttcaggaatcacctttcacgttgagtcgggtcctacaacatagaccttacagaggtctgatgccacatttgcactttgagcaaaaacacacagttactttaatcaccctcgaaatacctatctgtaattgttttattcaattatttttttgtcctatccatagaacttgggcagctcaacttgattgttgatacctacaaaatggtgaggctaaggtcacctgtgatgtggctgttgcttcgagaggaagcagtaaatctttattggaatgccagggttccgttgtgtgtccactaatgtttctctatggtagccaggaagacttgtgtatgctgggctggtggtaatacaagaggtaaccccaggacagtttctgcacaatgaagttgtacaagtagagctccagaaaaatgtctctctcctctgacctttatttaaagaagggacaacaagcgtcttgactactttccctttcctccttagggaagacattcttccaagtatcaagaaagggagcccttgcttccctggaagacatttcctcccagcaatccctctccagttccatgtgaccattcctactctgagccagttttggaaaggaaggtaagtggttggattaggttaggtgatatccaagtagatgtagccgaattctgtctaggactgggtcaatgatgacaacccaatgtcatgaacaaaggtgatgacataaaattcatgctcaataggattacgctgaggcccaaccagggcgacagggtcacaagacgtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcattcctgcaaggatcaccccttgctcatgacaatgtcttttctggtgttttgcagtcatctcacatgccaccttggaaggcatagaaacacagataatcaggtaagtggtcagaacatggtaaagcctccacatccaggtgacctcccccttcatgatttggctttcaattctcagccagtcggtccttttggaattagggataacacaatggtatacaacagtaccaaaggagctcgatttaggctatgttctccgatgtacatcccctggtttgtaacgttttaaggaatgtgttcaactcccgataattgttttttcataattttgacctacttctcatggagagaggaggatgacattttttgaatgttgggatctcatactttgatgcttacaattttatggcaaatagctacaggaggacaacactggcctccagggccttatggtactcttcctttcccttgacaggggaggcccaagtgacagatcctttcttagggaaaaagaaggattctatgatatccaaaaaggctgtcctccccaggatgggttcacaaagggcaatccctctagcagatattccaaagatctcaccccagagacaatttaccaatgtggatagggtgagatattcatttttaccttggtgcccaccacattccaaatttccttcatggtatcatttagggcacttactgaacctcactgcagaatcactgaggaaaaaaagctctacacattaggttgatacacggtaaggccaggtgtttaaagaacctaattccactttgattcataacaccaaggcctgactttagtccagcaacagtgcttacactcacgttttacagcagggcaacccataacacgttgacacaaatggatacatgtatagacatgggttctgtggcctcggtccaggattctcgggagattttcaggaatcacctttcacgttgagtcgggtcctacaacatagaccttacagaggtctgatgccacatttgcactttgagcaaaaacacacagttactttaatcaccctcgaaatacctatctgtagttgttttattcaattattttttgtcctatccatagaacttcggcagctcaacttgagtgttgatacctacaaaatggtgaggctaaggtcacctgtgatgtggctgttgcttcgagaggaagcagtaaatctttattggaatgccagggttccgttgtgtgtccactgatgtttctctatggtagccaggaagacttgtgtatgctgggctggtagtaatacaagaggtaaccccaggacagtttctgcacaatatagttgtacaagtagagctccagaaaaatgtctctctcctctgacctttattaaagaagggacaacaagcatcttgacttctttccctttcctccttagggaagacattcttccaagtatcaagaaagggagcccttgcttccctggaagacatttcgtcccagcaatccctctccagttccatgtgaccattcctactctgagccagttttggaaaggaaggtaagtggttggattaggttaggtgatatccaagtagatgtagccgaattctgtctaggactgggtcaatgatgacaacccaatgtcatgaacaaaggtgatgacataaaattcatgctcaataggattacactgaggcccaaccagggcgacagggtcacaagaggtccgttgactccttggggggctctagggtgacttccctgaagtcctcagatgcccttgccctgtttcccatgagaggaaatgtggacatctagggtgcacattggttggcaaacactgcatgccaacaagcacctagtcgcacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaattagggataacaaaatggtatacaacggtaccaaaggagctcgatttaggctatgttctccgatgtacatcccctggtttgtaacgttttaaggaatgtcttcaactcacgataattgttttttcataattttgacctacttctcatggagagaggaggatgacattttttgaatgttgggatctcatactttgatgcttacaatttcattgcaaatagctacaggaggacaacactggcctccagggccttatggtactcttcctttcccttgacaggggaggcccaagtgacagatcctttcttagggaaaaacaaggattctatgatatccaaaaaggctgtcctccccaagatgggttcacaaagggcaatccctctagcagatattccaaagatctcaccccagagacaatttaccaatgtggatagggtgagatattcatttttaccttggtgcccaccacattccaaatttccttcatggtatcatttagggcacttactgaacctcactgcagaatcactgaggaaaaaaagctctacacattaggttgatacagggtaaggccaggtgtttaaagaacctaattccactttgattcataacaccaaggcctgactttagtccagcaacagtgcttacactcacgttttacagcagggcaacccataacaggttgacacaaatggatacatgtatagacatgggttctgtggcctcggtccaggattctcgggagattttcaggaatcactgttcacgttgagtcgggtcctacaacatagaccttacagaggtctgatgccacatttgcactttgagcaaaaacacacagttactttaatcaccctcgaaatacctatctgtaattgttttattcaattatttttttgtcctatccatagaacttgggcagctcaacttgattgttgatacctacaaaatggtgaggctaaggtcacctgtgatgtggctgttgcttcgagaggaagcagtaaatctttattggaatgccagggttccgttgtgtgtccactaatgtttctctatggtagccaggaagacttgtgtatgctgggctggtggtaatacaagaggtaaccccaggacagtttctgcacaatgaagttgtacaagtagagctccagaaaaatgtctctctcctctgacctttatttaaagaagggacaacaagcgtcttgactactttccatttcctccttagggaagacattctaccaagtatcaagaagggagcccttgcttccctggaagacatttcctcccagcaatccctctccagttccatgtgaccattcctactctgagccagttttggaaaggaaggtaagtggttggattaggttaggtgatatccaagtagatgtagccgaattctgtctaggactgggtcaatgatgacaacccaatgtcatgaacaaagtgatgacataaaattcatgctcaataggattaggctgaggcccaaccagggcgacagggtcacaagacgtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaattagggataacaaaatggtatacaacggtaccaaaggagctcgatttaggctatgttctccgatgtacatcccctggtttgtaacggtttaaggaatgtcttcaactcccgataattgttttttcataattttgacctacttctcatggagagaggaggatgacattttttgaatgttgggatctcatactttgatgcttacaatttcattgcaaatagctacaggaggacaacactggcctccagggccttatggtactcttcctttcccttgacaggggaggcccaagtgacagatcctttcttagggaaaaacaaggattctatgatatccaaaaaggctgtcctccccacgatgtgttcacaaagggcaatccctctagcagatattccaaagatctcaccccagagacaatttaccaatgtggatagggtgagatattcatttttaccttggtgcccaccacattccaaatttccttcatggtatcatttagggcacttactgaacctcactgcagaatcactgaggaaaaaaagctctacacattaggttgatacagggtaaggccaggtgtttaaagaacctaattccactttgattcataacaccaaggcctgactttagtccagcaacagtgcttactctcacgttttacagcagggcaacccataacaggttgacacaaatggatacatgtatagacatgggttctgtggcctcggtccaggattctcgggagattttcaggaatcacctttcacgttgagtcgggtcctacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgattgttgatacctacaaaatggtgaggctaaggtcacctgtgatgtggctgttgcttcgagaggaagcagtaaatctttattggaatgccagggttccgttttgtgtccactgatgtttctctatggtagccaggaagacttgtgtatgctgggctggtggtaatacaagaggtaaccccaggacagtttctgcacaatgaagttgtacaagtagagctccagaaaaatgtctctctcctctgacctttatttaaagaagggacaacaagcgtcttgactactttccctttcctccttagggaagacattcttccaagtatcaagaaagggagcccttgcttccctggaagacatttcctcccagcaatccctctccagttccatgtgaccattcctactctgagccagttttggaaaggaaggtaagtggttggattaggttaggtgatatccaagtagatgtagccgaattctgtctaggactgggtcaatgatgacaacccaatgtcatgaacaaaggtgatgacataaaattcatgctcaataggattacgctgaggcccaaccagggcgacagggtcacaagacgtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcaccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaattagggataacaaaatggtatacaacggtaccaaaggagctcgatttaggctatgttctccgatgtacatcccctggtttgtaacgttttaaggaatgtgttcaactcccgataattgttttttcataattttgacctacttctcatggagagaggaggatgacattttttgaatgttgggatctcatactttgatgcttacaattttatggcaaatagctacaggaggacaacactggcctccagggccttatggtactattcctttcccttgacaggggaggcccaagtgacagatcctttcttagggaaaaagaaggattctatgatatccaaaaaggctgtcctactcaggatgggttcacaaagggcaatccctctagcagatattccaaagatctcaccccagagacaatttaccaatgtggatagggtgagatattcatttttaccttgttacccaccacattccaaatttccttcatggtatcatttagggcacttactgaacctcactgcagaatcactgaggaaaaaaagctctacacattaggttgatacacggtaaggccaggtgtttaaagaacctaattccactttgattcataacaccaaggcctgactttagtccaggaacagtgcttacactcacgttttacagcagggcaacccataacacgttgacacaaatggatacatgtatagacatgggttctgtggcctcggtccaggattctctggagattttcaggaatcacctttcacgttgagtcgggtcctacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgattgttgatacctacaaaatggtgaggctaaggtcacctgtgatgtggctgttgcttcgagaggaagcagtaaatctttattggaatgccagggttccgttgtgtgtccactgatgtttctctatggtagccaggaagacttgtgtatgctgggctggtagtaatacaagaggtaaccccaggacagtttctgcacaatgaagttgtacaagtagagctccagaaaaatgtctctctccactgacctttatttaaagaagggacaacaagcgtcttgactactttccctttcctccttagggaagacattcttccaagtatcaagaaagggatcccttgcttccctggaagacatttcctcccagcaatccctctccagttccatgtgaccattcctactctgagccagttttggaaaggaaggtaagtggttggattaggttaggtgatatccaagtagatgtagccgaattctgtctaggactgggtcaatgatgacaacccaatgtcatgaacaaaggtgatgacataaaattcatgctcaataggattacgctgaggcccaaccagggcacagggtcacaagaggtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcaccccttgctcatgacaatgtcttttctggtgttttgcagtcatctcacatgccaccttggaaggcagagaaacacagataatcaggtaagtggtcagaacatggtaaagcctccacatccaggtgacctcccccttcaagatttggctttcaattctcagccagtcggtccttttggaattagggataacaaaatggtatacaagggtaccaaaggagctcgatttaggctatgttctccgatgtacatcccctggtttgtaacgttttaaggaatgtcttcaactcccgataattgttttttcataattttgacctacttctcatggagagaggaggatgacagtttttgaatgttgggatctcatactttgatgcttacaattttatggcaaatagctacaggaggacaacactggcctccagggccttatggtactcttcctttcccttgacaggggaggcccaagtgacagatcctttcttagggaaaaacaaggattctatgatatccaaaaaggctgtcctccccaggatgggttcacaaagagcaatccctctagcagatattccaaagatctcaccccagagacaatttaccaatgtggatagggtgagatattcatttttaccttggtaccaaccacattccaaatttccttcatggtatcatttagggcacttactgaacctcactgcagaatcactgaggaaaaaaagctctacacattaggttgatacagggtaaggccaggtgtttaaagaacctaattccactttgattcataacaccaaggcctgactttagtccagcaacagtgcttacactcacgttttacagcagggcaacccataacaggttgacacaaatggatacatgtatagacatgggttctgtggcctcggtccaggattctcgggagattttcaggaatcacctttaacgttgagtcgggtcctacaacatagaccttacagaggtctgatgccacatttgcactttgagcaaaaacacacagttactttaatcaccctcgaaatacctatctgtaattgttttattcaattatttttttgtcctatccatagaacttgggcagctcaacttgagtgttgatacctacaaaatggtgaggctaaggtcacctgtgatgtggctgttgcttcgagaggaagcagtaaatctttattggaatgccagggttccgttgtgtgtccactgatgtttctctatggtagccaggaagacttgtgtatgctgggctggtagtaatacaagaggtaaccccaggacagtttctgcacaatgaagttgtacaagtagagctccagaaaaatgtctctctcctctgacctttatttaaagaagggacaacaagcgtcttgactactttccctttcctccttagggaagacattcttccaagtatcaagaaagggagcccttgcttccctggaagacatttcctcccagcaatccctctccagttccatgtgaccattcctactctgagccagttttggaaaggaaggtaagtggttggattaggttaggtgatatccaagtagatgtagccgaattctgtctaggactgggtcaatgatgacaacccaatgtcatgaacaaaggtgatgacataaaattcatgctcaataggattacgctgaggcccaaccagggcgacagggtcacaagacgtccgttgactccttggggggctctagggtgacttccctgaagtcctcagatgcccttgccctgtttcccatgagaggaaatgtggacatctagggtgcacattggttggcaaacactgcatgccaacaagcacctagtcccacagtggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaatttggggataacaaaatggtatgcaaaggtaccaaaggagctcgatttaggctatgttctccgatgtacatcccctggtttgtaacgttttaaggaatgtcttcaactcccgataattgttttttcataattttgacctacttctcatggagagaggaggatgacagtttttgaatgttgggatctcatactttgatgcttacaattttatggcaaatagctacaggaggacaacactggcctccagggccttatggtactcttcctttcccttgacaggggaggcccaagtgacagatcctttcttagggaaaaacaaggattctatgatatccaaaaaggctgtcctccccaagatgggttcacaaagagcaatccctctagcagatattccaaagatctcaccccagagacaatttaccaatgtggatagggtgagatattcatttttaccttggtaccaaccacattccaaatttccttcatggtatcatttagggcacttactgaacctcactgcagaatcactgaggaaaaaaagctctacacattaggttgatacagggtaaggccaggtgtttaaagaacctaattccactttgattcataacaccaaggcctgactttagtccagcaacagtgcttacactcacgttttacagcagggcaacccataacaggttgacacaaatggatacatgtatagacatgggttctgtggcctcggtccaggattctcgggagattttcaggaatcacctttcacgttgagtcgggtcctacaacatagaccttacagaggtctgatgccacatttgcactttgagcaaaaacacacagttactttaatcaccctcgaaatacctatctgtaattgttttattcaattatttttttgtcctatccatagaacttgggcagctcaacttgagtgttgatacctacaaaatggtgaggctaaggtcacctgtgatgtggctgttgcttcgagaggaagcagtaaatctttattggaatgccagggttccgttgtgtgtccactgatgtttctctatggtagccaggaagacttgtgtatgctgggctggtagtaatacaagaggtaaccccaggacagtttctgcacaatgaagttgtacaagtagagctccagaaaaatgtctctctcctctgacctttatttaaagaagggacaacaagcgtcttgactactttccctttcctccttagggaagacattcttccaagtatcaagaaagggagcccttgcttccctggaagacatttcctcccagcaatccctctccagttccatgtgaccattcctactctgagccagttttggaaaggaaggtaagtggttggattatgttaggtgatatccaagtagatgtagccgaattctgtctaggactgggtcaatgatgacaacccaatgtcatgaacaaaggtgatgacataaaattcatgctcaataggattacgctgaggcccaaccagggcgacagggtcacaagacgtccgttgactccttggggggctctagggtgacttccctgaagtcctcagatgcccttgccctgtttcccatgagaggaaatgtggacatctagggtgcacattggttggcaaacactgcatgccaacaagcacctagtcccacagtggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaatttggggataacaaaatggtatgcaaaggtaccaaaggagctcgatttaggctatgttctccgatgtacatcccctggtttgtaacgttttaaggaatgtcttcaactcccgataattgttttttcataattttgacctacttctcatggagagaggaggatgacagtttttgaatgttgggatctcatactttgatgcttacaattttatggcaaatagctacaggaggacaacactggcctccagggccttatggtactcttcctttcccttgacaggggaggcccaagtgacatattctttcttaggaaaaaagaaggattctttgatatccaaaaagtctgtcctccccaggatgggttcacaaagggcaatccctctagcagatattccaaagatctcaccccagagacaatttaccaatgtggatagggtgagatattcatttttaccttggtacccaccacattccaaatttccttcatggtatcatttagggcacttactgaacctcactgcagaatcactgaggaaaaaaagctctacacattaggttgatacacggtaaggccaggtgtttaaagaacctaattccactttgattcataacaccaaggcctgactttagtccaggaacagtgcttacactcacgttttacagcagggcaacccataacacgttgacacaaatggatacatgtatagacatgggttctgtggcctcggtccaggattctcgggagattttcaggaatcacctttcacgttgagtcgggtcctacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatacctacaaaatggtgaggctaaggtcacctgtgatgtggctgttgcttcgagaggaagcagtaaatctttattggaatgccagggttccattgtgtgtccactgatgtttctctatggtagccaggaagacttgtgtatgctgggctggtagtaatacaagaggtaaccccaggacagtttctgcacaatgaagttgtacaagtagagctccagaaaaatgtctctctcctctgacctttatttaaagaagggacaacaagcatcttgacttcttttcctttcctccttagggaagacattcttccaagtatcaagaaagggagcccttgcttccctggaagacatttcctcccagcaatcactctccagttccatgtgaccattcctactctgatccagatttggaaaggaaggtaagtggttggattaggttaggtgatatccaagtagatgtagccgaattctgtctaggactgggtcaatgatgacaacccaatgtcatgaacaaaggtgatgacataaaattcatgctcaataggattacgctgaggcccaaccagggcgacagggtcacaagacgtccgttgactccttggggggctctagggtgacttccctgaagtcctcagatgcccttgccctgtttcccatgagaggaaatgtggacatctagggtgcacattggttggcaaacactgcatgccaacaagcacctagtcccacagtggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaatttggggataacaaaatggtatgcaaaggtaccaaaggagctcgatttaggctatgttctccgatgtacatcccctggtttgtaacgttttaaggaatgtcttcaactcccgataattgttttttcataattttgacctacttctcatggagagaggaggatgacagtttttgaatgttgggatctcatactttgatgcttacaattttatggcaaatagctacaggaggacaacactggcctccagggccttatggtactcttcctttcccttgacaggggaggcccaagtgacagatcctttcttagggaaaaacaaggattctatgatatccaaaaaggctgtcctccccaagatgggttcacaaagagcaatccctctagcagatattccaaagatctcaccccagagacaatttaccaatgtggatagggtgagatattcatttttaccttggtaccaaccacattccaaatttccttcatggtatcatttagggcacttactgaacctcactgcagaatcactgaggaaaaaaagctctacacattaggttgatacagggtaaggccaggtgtttaaagaacctaattccactttgattcataacaccaaggcctgactttagtccagcaacagtgcttacactcacgttttacagcagggcaacccataacaggttgacacaaatggatacatgtatagacatgggttctgtggcctcggtccaggattctcgggagattttcaggaatcacctttcacgttgagtcgggtcctacaacatagaccttacagaggtctgatgccacatttgcactttgagcaaaaacacacagttactttaatcaccctcgaaatacctatctgtaattgttttattcaattatttttttgtcctatccatagaacttgggcagctcaacttgagtgttgatacctacaaaatggtgaggctaaggtcacctgtgatgtggctgttgcttcgagaggaagcagtaaatctttattggaatgccagggttccgttgtgtgtccactgatgtttctctatggtagccaggaagacttgtgtatgctgggctggtagtaatacaagaggtaaccccaggacagtttctgcacaatgaagttgtacaagtagagctccagaaaaatgtctctctcctctgacctttatttaaagaagggacaacaagcgtcttgactactttccctttcctccttagggaagacattcttccaagtatcaagaaagggagcccttgcttccctggaagacatttcctcccagcaatccctctccagttccatgtgaccattcctactctgagccagttttggaaaggaaggtaagtggttggattaggttaggtgatatccaagtagatgtagccgaattctgtctaggactgggtcaatgatgacaacccaatgtcatgaacaaaggtgatgacataaaattcatgctcaataggattacgctgaggcccaaccagggcgacagggtcacaagacgtccgttgactccttggggggctctagggtgacttccctgaagtcctcagatgcccttgccctgtttcccatgagaggaaatgtggacatctagggtgcacattggttggcaaacactgcatgccaacaagcacctagtcccacagtggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaatttggggataacaaaatggtatgcaaaggtaccaaaggagctcgatttaggctatgttctccgatgtacatcccctggtttgtaacgttttaaggaatgtcttcaactcccgataattgttttttcataattttgacctacttctcatggagagaggaggatgacagtttttgaatgttgggatctcatactttgatgcttacaattttatggcaaatagctacaggaggacaacactggcctccagggccttatggtactcttcctttcccttgacaggggaggcccaagtgacatatcctttcttaggaaaaaagaaggattctttgatatccaaaaagtctgtcctccccaggatgggttcacaaagggcaatccctctagcagatattccaaagatctcaccccagagacaatttaccaatgtggatagggtgagatattcatttttaccttggtacccaccacattccaaatttccttcatggtatcatttagggcacttactgaacctcactgcagaatcactgaggaaaaaaagctctacacattaggttgatacacggtaaggccaggtgtttaaagaacctaattccactttgattcataacaccaaggcctgactttagtccaggaacagtgcttacactcacgttttacagcagggcaacccataacacgttgacacaaatggatacatgtatagacatgggttctgtggcctcggtccaggattctcgggagattttcaggaatcacctttcacgttgagtcgggtcctacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatacctacaaaatggtgaggctaaggtcacctgtgatgtggctgttgcttcgagaggaagcagtaaatctttattggaatgccagggttccattgtgtgtccactgatgtttctctatggtagccaggaagacttgtgtatgctgggctggtagtaatacaagaggtaaccccaggacagtttctgcacaatgaagttgtacaagtagagctccagaaaaatgtctctctcctctgacctttatttaaagaagggacaacaagcatcttgacttcttttcctttcctccttagggaagacattcttccaagtatcaagaaagggagcccttgcttccctggaagacatttcctcccagcaatcactctccagttccatgtgaccattcctactctgatccagatttggaaaggaaggtaagtggttggattaggttaggtgatatccaagtagatgtagccgaattctgtctaggactgggtcaatgatgacaacccaatgtcatgaacaaaggtgatgacataaaattcatgctcaataggattacgctgaggcccaaccagggcgacagggtcacaagacgtccgttgactccttggggggctctagggtgacttccctgaagtcctcagatgcccttgccctgtttcccatgagaggaaatgtggacatctagggtgcacattggttggcaaacactgcatgccaacaagcacctagtcccacagtggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaatttggggataacaaaatggtatgcaaaggtaccaaaggagctcgatttaggctatgttctccgatgtacatcccctggtttgtaacgttttaaggaatgtcttcaactcccgataattgttttttcataattttgacctacttctcatggagagaggaggatgacagtttttgaatgttgggatctcatactttgatgcttacaattttatggcaaatagctacaggaggacaacactggcctccagggccttatggtactcttcctttcccttgacaggggaggcccaagtgacatatcctttcttaggaaaaaagaaggattctttgatatccaaaaagtctgtcctccccaggatgggttcacaaagtgcaatccctctagcagatattccaaagatctcaccccagagacaatttaccaatgtggatagggtgagatattcatttttaccttggtacccaccacattccaaatttccttcatggtatcatttagggcacttactgaacctcactgcagaatcactgaggaaaaaaagctctacacattaggttgatacacggtaaggccaggtgtttaaagaacctaattccactttgattcataacaccaaggcctgactttagtccagcaacagtgcttactctcacgttttacagcagggcaacccataacaggttgacacaaatggatacatgtatagacatgggttctgtggcctcggtccaggattctcgggagattttcaggaatcacctttcacgttgagtcgggtcctacaacatagaccttacagaggtctgatgccacatttgcactttgagcaaaaacacacagttactttaatcaccctcgaaatacctatctgtaattgttttattcaattatttttttgtcctatccatagaacttgggcagctcaacttgattgttgatacctacaaaatggtgaggctaaggtcacctgtgatgtggctgttgcttcgagaggaagcagtaaatctttattggaatgccagggttccgttgtgtgttcactaatgtttctctatggtagccagcaagacttgtgtatgctgggctggtggtaatacaagaggtaaccccaggacagtttctgcacaatgaagttgtacaagtagagctccagaaaaatgtctctctcctctgacctttatttaaagaagggacaacaagcgtcttgactactttccctttcctccttagggaagacattcttccaagtatcaagaaagagagcccttgcttccctggaagacatttcctcccagcaatccctctccagttccatgtgaccattcctactctgagccagttttggaaaggaaggtaagtggttggattaggttaggtgatatccaagtagatgtagctgaattctgtctaggactgggtcaatgatgacaacccaatgtcatgaacaaaggtgatgacataaaattcatgctcaataggattacgctgaggcccaaccagggcgtcagggtcacaagacgtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcgtgatttggctttcaattctcagccagtcggtccttttggaattagggataacaaaatggtatacaacggtaccaaaggagctcgatttaggctatgttctccgatgtacatcccctggtttgtaacgttttaaggaatgtgttcaactcccgaaaattgttttttcataattttgacctacttctcatggagagaggaggatgacattttttgaatgttgggatctcatactttgatgcttacaattttatggcaaatagctacaggaggacaacactggcctccagggccttatggtactcttcctttcccttgacaggggaggcccaagtgacagatcctttcttagggaaaaagaaggattctatgatatccaaaaagtctgtcctccccaggatgggttcacaaagggcaatccctctagcagatattccaaagacctcaacccagagacaatttaccaatgtggatagggtgagatattcatttttaccttggtacccaccacattccaaatttccttcatggtatcatttagggcacttactgaacctcactgcagaatcactgaggaaaaaaagctctacacattaggttgatacacggtaaggccaggtgtttaaagaacctaattccactttgattcataacaccaaggcctgactttagtccagcaacagtgcttacactcacgttttacagcagggcaacccataacaggttgacacaaatggatacatgtatagacatgggttctgtggcctcggtccaggattctcgggagattttcaggaatcacctttcacgttgagtcgggtcctacaacatagaccttacagaggtctgatgccacatttgcactttgagcaaaaacacacagttactttaatcaccctcgaaatacctatctgtaattgttttattcaattatttttttgtcctatccatagaacttgggcagctcaacttgagtgttgatacctacaaaatggtgaggctaaggtcacctgtgatgtggctgttgcttcgagaggaagcagtaaatctttattggaatgccagggttccgttgtgtgtccactgatgtttctctatggtagccaggaagacttgtgtatgctgggctggtagtaatacaagaggtaaccccaggacagtttctgcacaatgaagttgtacaagtagagctccagaaaaatgtctctctcctctgacctttatttaaagaagggacaacaagcgtcttgactactttccctttcctccttagggaagacattcttccaagtatcaagaaagggagcccttgcttccctggaagacatttcctcccagcaatccctctccagttccatgtgaccattcctactctgagccagttttggaaaggaaggtaagtggttggattaggttaggtgatatccaagtagatgtagccgaattctgtctaggactgggtcaatgatgacaacccaatgtcatgaacaaaggtgatgacataaaattcatgctcaataggattacgctgaggcccaaccagggcgacagggtcacaagacgtccgttgactccttggggggctctagggtgacttccctgaagtcctcagatgcccttgccctgtttcccatgagaggaaatgtggacatctagggtgcacattggttggcaaacactgcatgccaacaagcacctagtcccacagtggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaatttggggataacaaaatggtatgcaaaggtaccaaaggagctcgatttaggctatgttctccgatgtacatcccctggtttgtaacgttttaaggaatgtcttcaactcccgataattgttttttcataattttgacctacttctcatggagagaggaggatgacagtttttgaatgttgggatctcatactttgatgcttacaattttatggcaaatagctacaggaggacaacactggcctccagggccttatggtactcttcctttcccttgacaggggaggcccaagtgacatatcctttcttaggaaaaaagaaggattctttgatatccaaaaagtctgtcctccccaggatgggttcacaaagggcaatccctctagcagatattccaaagatctcaccccagagacaatttaccaatgtggatagggtgagatattcatttttaccttggtacccaccacattccaaatttccttcatggtatcatttagggcacttactgaacctcactgcagaatcactgaggaaaaaaagctctacacattaggttgatacacggtaaggccaggtgtttaaagaacctaattccactttgattcataacaccaaggcctgactttagtccaggaacagtgcttacactcacgttttacagcagggcaacccataacacgttgacacaaatggatacatgtatagacatgggttctgtggcctcggtccaggattctcgggagattttcaggaatcacctttcacgttgagtcgggtcctacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatacctacaaaatggtgaggctaaggtcacctgtgatgtggctgttgcttcgagaggaagcagtaaatctttattggaatgccagggttccattgtgtgtccactgatgtttctctatggtagccaggaagacttgtgtatgctgggctggtagtaatacaagaggtaaccccaggacagtttctgcacaatgaagttgtacaagtagagctccagaaaaatgtctctctcctctgacctttatttaaagaagggacaacaagcatcttgacttcttttcctttcctccttagggaagacattcttccaagtatcaagaaagggagcccttgcttccctggaagacatttcctcccagcaatcactctccagttccatgtgaccattcctactctgatccagatttggaaaggaaggtaagtggttggattaggttaggtgatatccaagtagatgtagccgaattctgtctaggactgggtcaatgatgacaacccaatgtcatgaacaaaggtgatgacataaaattcatgctcaataggattacgctgaggccgaaccagggcgacagggtcacaagaggtccgttgactccttggggggctctagggtgacttccctgaagtcctcagatgcccttgccctgtttcccatgagaggaaatgtggacatctagggtgcacattggttggcaaacactgcatgccaacaaacacctagtcccacaatggaaccttgggcatttctgcaaggatcgccccttgctcatgacaatgtcttttctggagttttgcagtcatctcacatgccaccttggaaggcagagaaacacagataatcaggtaagtggtcagaacatggtaaagcctccacatccaggtgacctcccccttcatgatttggctttcaattctcagccagtctgttcttttgcaatttggtgataacaaaatggtatgcaacagtaccaaaggagctcgatttaggctatgttctccgatgtacatcccctggtttgtaacgttttaaggaatgtcttcaactcccgataattgttttttcataattttgacctacttctcatggagagaggaggatgacattttttgaatgttgggatctcatactttgatgcttacaatttcattgcaaatagctacaggaggacaacactggcctccagggccttatggtactcttcctttcccttgacaggggaggcccaagtgacagatcctttcttagggaaaaagaaggattctatgatatccaaaaaggctgtcctccacacgatgggttcacaaagggcaatccctctagcagatattccaaagatctcaccccagagacaatttaccaatgtggatagggtgagatattcatttttaccttggtgcccaccacattccaaatttccttcatggtatcatttagggcacttactgaacctcactgcagaatcactgaggaaaaaaagctctacacattaggttgatacagggtaaggccaggtgtttaaagaacctaattccactttgattcataacaccaaggcctgactttagtccagcaacagtgcttactctcacgttttacagcagggcaacccataacaggttgacacaaatggatacatgtatagacatgggttctgtggcctcggtccaggattctctggagattttcaggaatcacctttcacgttgagtcgggtcctacaacatagaccttacagaggtctgatgccacatttgcactttgagcaaaaacacacagttactttaatcaccctcgaaatacctatctgtaattgttttattcaattatttttttgtcctatccatagaacttgggcagctcaacttgattgttgatacctacaaaatggtgaggctaaggtcacctgtgatgtggctgttgcttcgagaggaagcagtaaatctttattggaatgccagggttccgttgtgtgtccactaatgtttctctatggtagccagcaagacttgtgtatgctgggctggtggtaatacaagaggtaaccccaggacagtttctgcacaatgaagttgtacaagtagagctccagaaaaatgtctctctcctctgacctttatttaaagaagggacaacaagcgtcttgactactttccctttcctccttagggaagacattcttccaagtatcaagaaagagagcccttgcttccctggaagacatttcctcccagcaatccctctccagttccatgtgaccattcctactctgagccagttttggaaaggaaggtaagtggttggattaggttaggtgatatccaagtagatgtagctgaattctgtctaggactgggtcaatgatgacaacccaatgtcatgaacaaaggtgatgacataaaattcatgctcaataggattacgctgaggcccaaccagggcgacagggtcacaagacgtccgttgactccttggggggctctagggtgacttccctgaagtcctcagatgcccttgccctgtttcccatgagaggaaatgtggacatctagggtgcacattggttggcaaacactgcatgccaacaagcaactagtcccacaatggaaccttgggcatttctgcaaggatcaccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaatgagggataacaaaatggtatacaacggtaccaaaggagctcgatttaggctatgttctccgatgtacatcacctggtttgtaacgttttaaggaatgtcttcaactcccgataattgttttttcataattttgacctacttctcatggagagaggaggatgacagtttttgaatgttgggatctcatactttgatgcttacaatttcattgcaaatagctacaggaggacaacactggcctccagggccttatggtactcttcctttcccttgacaggggaggcccaagtgacagatcctttcttagggaaaaagaaggattctatgatatccaaaaaggctgtcctccccacgatgggttcacaaagggcaatccctctagcagatattccaaagatctcaccccagagacaatttaccaatgtggatagggtgagatattcatttttaccttggtgcccaccacattccaaatttccttcatggtatcatttagggcacttactgaacctcactgcagaatcactgaggaaaaaaagctctacacattaggttgatacagggtaaggccaggtgtttaaagaacctaattccactttgattcataacaccaaggcctgactttagtccagcaacagtgcttactctcacgttttacagcagggcaacccataacaggttgacacaaatggatacatgtatagacatgggttctgtggcctcggtccaggattctcgggagattttcaggaatcacctttcacgttgagtcgggtcctacaacatagaccttacagaggtctgatgccacatttgcactttgagcaaaaacacacagttactttaatcaccctcgaaatacctatctgtaattgttttattcaattatttttttgtcctatccatagaacttgggcagctcaacttgattgttgatacctacaaaatggtgaggctaaggtcacctgtgatgtggctgttgcttcgagaggaagcagtaaatctttattggaatgccagggttccgttgtgtgtccactaatgtttctctatggtagccaggaagacttgtgtatgctgggctggtggtaatacaagaggtaaccccaggacagtttctgcacaatgaagttgtacaagtagagctccagaaaaatgtctctctcctctgacctttatttaaagaagggacaacaagcgtcttgactactttccctttcctccttagggaagacattcttccaagtatcaagaaagggagcccttgcttccctggaagacatttcctcccagcaatccctctccagttccatgtgaccattcctactctgagccagttttggaaaggaaggtaagtggttggattaggttaggtgatatccaagtagatgtagccgaattctgtctaggactgggtcaatgatgacaacccaatgtcatgaacaaaggtgatgacataaaattcatgctcaataggattacgctgaggcccaaccagggcgacagggtcacaagacgtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcaccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaattagggataacaaaatggtatacaacggtaccaaaggagctcgatttaggctatgttctccgatgtacatcccctggtttgtaatgttttaaggaatgtcttcaactcccgataattgttttttcataattttgacctacttctcatggagagaggaggatgacattttttgaatgttgggatctcatactttgatgcttacaattttatggcaaatagctacaggaggacaacactggtctccagggccttatggtactcttcctttcccttgacaggggaggcccaagtgacagatcctttcttagggaaaaagaaggattctatgatatccaaaaaggctgtcctccccaggatgggttcacaaagggcaatccctctagcagatattccaaagagctcaccccagagacaatttaccaatgtggatagggtgagatattcatttttaccttggtacccaccacattccaaatttccttcatagtatcatttagggcacttactgaacctcactgcagaatcactgaggaaaaaaaactctacacattaggttgatacacggtaaggccaggtgtttaaagaacctaattccactttgattcataacaccaaggcctgactttagtccagcaacagtgcttacactcacgttttacagcagggcaacccataacacgttgacacaaatggatacatgtatagacatgggttctgtggcctcggtccaggattctcgggagattttcaggaatcacctttcacgttgagtcgggtcctacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatacctacaaaatggtgaggctaaggtcacctgtgatgtggctgttgcttcgagaggaagcagtaaatctttattggaatgccagggttccgttgtgtgtccactgatgtttctctatggtagccaggaagacttgtgtatgctgggctggtagtaatacaagaggtaaccccaggacattttctgcacaatgaagttgtacaagtagagctccagaaaaatgtctctctcctctgacctttattaaagaagggacaacaagcgtcttgactactttccctttcctccttagggaagacattcttccaagtatcaagaaagggagcccttgcttccctggaagacatttcctcccagcaatccctctccagttccatgtgaccattcctactctgagccagttttggataggaaggtaagtggttggattaggttaggtgatatccaagtagatgtagctgaattctgtctaggactgggtcaatgatgacaacccaatgtcatgaagaaaggtgatgacataaaattcatgctcaataggattacgctgaggcccaaccagggcgacagggtcacaagaggtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcaagatttggctttcaattctcagccagtcggtccttttggaattagggataacaaaatggtatacaacggtaccaaaggagctcgatttaggctatgttctccgatgtacatcccctggtttgtaacgttttaaggaatgtcttcaactcccgataattgttttttcataattttgacctacttctcatggagagaggaggatgacattttttgaatgttgggatctcatactttgatgcttacaattttatggcaaatagctacaggaggacaacactggcctccagggccttatggtactcttcctttcccttgacaggggaggcccaagtgacagatcctttcttagggaaaaagaaggattctatgatatccaaaaatctgtcctccccaggatgggttcacaaagggcaatccctctagcagatattccaaagatctcaccacagagacaatttaccaatgtggatagggtgagatattcatttttaccttggtacccaccacattccaaatttccttcatggtatcatttagggcacttactgaacctcactgcagaatcactgaggaaaaaaagctctacacattaggttgatacagggtaaggccaggtgtttaaagaacctaattccactttgattcataacaccaagtcctgacttgaggacttgagtccagcaacagtggttaccctcaggttttacagcagggcaacccataacacgttgacacaaatggatacatgtatagtcatgggttctgtggcctcggtccaggattctcgggagattttcaggaatcacctttcacgttgagtcgggtcctacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatacctacaaaatggtgaggctaaggtcacctgtgatgtggctgttgcttcgagaggaagcagtaaatctttatcggaatgccagggttccgttgtgtgtccactgatgtttctctatggtagccaggaagacttgtgtatgctgggctggtagtaatacaagaggtaaccccaggacagtttctgcacaatgaagttgtacaagtagagctccagaaaaatgtctctctcctctgacctttatttaaagaagggacaacaagcgtcttgacttctttccctttcctccttagggaagacattcttccaagtatcaagaaagggagcccttgcttccctggaagacatttcctcccagcaatccctctccaggtccatgtgaccattcctactctgatccagatttggaaaggaaggtaagtggttggattaggttaggtgatatccaagtagatgtagccgaattctgtctaggactgggtcaatgatgacaacccaatgtcatgaagaaaggtgatgacataaaattcatgctcaataggattacgctgaggcccaaccagggcgacagggtcacaagacgtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaattagggataacaaaatggtatacaacggtaccaaaggagctcgatttaggctatgttctccgatgtacatcccctggtttgtaacgttttaaggaatgtcttcaactcccaataattgttttttcataattttgacctacttctcatggagagaggaggatgacattttttgaatgttgggatctcatactttgatgcttacaattttatggcaaatagctacaggaggacaacactggcctccagggccttatggtactcttcctttcccttgacaggggaggcccaagtgacagatcctttcttagggaaaatgaaggattctatgatatccaaaaaggctgtccttcccacgatgtgttcacaaagggcaatccctctagcagatattccaaagatctcaccccagagacaatttaccaatgtggatagggtgagatattcatttttaccttggtacccaccacattccaaatttccttcatggtatcatttagggcacttactgaacctcactgcagaatcactgaggaaaaaaagctctacacattaggttgatacacggtaaggccaggtgtttaaagaacctaattccactttgattcataacaccaaggcctgactttagtccagcaacagtgcttacactcacgttttacagcagggcaacccataacacgttgacacaaatggatacatgtatagacatgggttctgtggcctcggtccaggattctcgggagattttcaggaatcacctttcacgttgagtcgggtcctacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatacctacaaaatggtgaggctaaggtcacctgtgatgtggctgttgcttcgagaggaagcagtaaatctttattggaatgccagggttcctttgtgtgtccactgatgtttctctatggtagccaggaagacttgtgtgtgctgggctgggagtaatacaagaggtaactccaggacagtttctgcacaatgaagttgtacaagtagagctccagaaaaatgtctctctcctctgacctttatttaaagaagggacaacaagcttcttgactactttccctttcctccttagggaagacattcttccaagtatcaagaaagggtgcccttgcttccctggaagacatttcctcccagcaatccctctccagttccatgtgaccattcctactctgagccagttttggaaaggaaggtaagtggttggattaggttaggtgatatccaagtagatgtagccgaattctgtctaggactgggtcaatgatgacaacccaatgtcatgaacaaaggtgatgacataaaattcatgctcaataggattacgctgaggcccaaccagggcgacagggtcacaagacgtccgttgactccttggggggctctagggtgacttccctgaagtcctcagatgcccttgccctgtttcccatgagaggaaatgtggacatctagggtgcatattggttggcaaacactgcatgcaaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcgtgatttggctttcaattctcagccagtcggtccttttggaattagggataacaaaatggtatacaacggtaccaaaggagctcgatttaggctatgttctccgatgtacatcccctggtttgtaacgttttaaggaatgtgttcaactcccgaaaattgttttttcataattttgacctacttctcatggagagaggaggatgacattttttgaatgttgggatctcatactttgatgcttacaattttatggcaaatagctacaggaggacaacactggcctccagggccttatggtactcttcctttcccttgacaggggaggcccaagtgacagatcctttcttagggaaaaagaaggattctatgatatccaaaaagtctgtcctccccaggatgggttcacaaagggcaatccctctagcagatattccaaagacctcaacccagagacaatttaccaatgtggatagggtgagatattcatttttaccttggtacccaccacattccaaatttccttcatggtatcatttagggcacttactgaacctcactgcagaatcactgaggaaaaaaagctctacacattaggttgatacacggtaaggccaggtgtttaaagaacctaattccactttgattcataacaccaaggcctgactttagtccagcaacagtgcttacactcacgttttacagcagggcaacccataacaggttgacacaaatggatacatgtatagacatgggttctgtggcctcggtccaggattctcgggagattttcaggaatcacctttcacgttgagtcgggtcctacaacatagaccttacagaggtctgatgccacatttgcactttgagcaaaaacacacagttactttaatcaccctcgaaatacctatctgtaattgttttattcaattatttttttgtcctatccatagaacttgggcagctcaacttgagtgttgatacctacaaaatggtgaggctaaggtcacctgtgatgtggctgttgcttcgagaggaagcagtaaatctttattggaatgccagggttccgttgtgtgtccactgatgtttctctatggtagccaggaagacttgtgtatgctgggctggtagtaatacaagaggtaaccccaggacagtttctgcacaatgaagttgtacaagtagagctccagaaaaatgtctctctcctctgacctttatttaaagaagggacaacaagcgtcttgactactttccctttcctccttagggaagacattcttccaagtatcaagaaagggagcccttacttccctggaagacatttcctcccagcaatccctctccagttccatgtgaccattcctactctgagccagttttggaaaggaaggtaagtggttggattaggttaggtgatatccaagtagatgtagccgaattctgtctaggactgggtcaatgatgacaacccaatgtcatgaacaaaggtgatgacataaaattcatgctcaataggattacgctgaggcccaaccagggcgacagggtcacaagacgtccgttgactccttggggggctctagggtgacttccctgaagtcctcagatgccctttccctgtttcccatgagaggaaatgtggacatctagggtgcacattggttggcaaacactgcatgccaacaagcacctagtcccacagtggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaatttggggataacaaaatggtatgcaaaggtaccaaaggagctcgatttaggctatgttctccgatgtacatcccctggtttgtaacggtttaaggaatgtcttcaactcccgataattgttttttcataattttgacctacttctcatggagagaggaggatgacagtttttgaatgttgggatctcatactttgatgcttacaattttatggcaaatagctacaggaggacaacactggcctccagggccttatggtactcttcctttcccttgacaggggaggcccaagtgacatatcctttcttaggaaaaaagaaggattctttgatatccaaaaagtctgtcctccccaggatgggttcacaaagtgcaatccctctaccagatattccaaagatctcaccccagagacaatttaccaatgtggatagggtgagatattcatttttaccttggtacccaccacattccaaatttccttcatggtatcatttagggcacttactgaacctcactgcagaatcactgaggaaaaaaagctctacacattaggttgatacacggtaaggccaggtgtttaaagaacctaattccactttgattcataacaccaaggcctgactttagtccaggaacagtgcttacactcacgttttacagcagggcaacccataacacgttgacacaaatggatacatgtatagacatgggttctgtggcctgggtccaggattctcgggagattttcaggaatcacctttcacgttgagtcgggtcctacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatacctacaaaatggtgaggctaaggtcacctgtgatgtggctgttgcttcgagaggaagcagtaaatctttattggaatgccagggttccgttgtgtgtccactgatgtttctctatggtagccaggaagacttgtgtatgctcggctggtagtaatacaagaggtaaccccaggacattttctgcacaatgaagttgtacaagtagagctccagaaaaatgtctctctcctctgacctttatttaaagaagggacaacaagcgtcttgactactttccctttcctccttagggaagacattcttccaagtatcaagaaagggagcccttgcttccctggaagacatttcctcccagcaatccctctccagttccatgtgaccattcctactctgagccagttttggataggaaggtaagtggttggattaggttaggtgatatccaagtagatgtagccgaattctgtctaggactgggtcaatgatgacaacccaatgtcatgaagaaaggtgatgacataaaattcatgctcaataggattacgctgaggcccaaccagggcgacagggtcacaagaggtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcaagatttggctttcaattctcagccagtcggtccttttggaattagcgataacaaaatggtatacaacggtaccaaaggagctcgatttaggctatgttctccgatgtacatcccctggtttgtaacgttttaaggaatgtcttcaactcccgataattgttttttcataattttgacctacttctcatggagagaggaggatgacattttttgaatgttgggatctcatactttgatgcttacaattttatggcaaatagctacaggaggacaacactggcctccagggccttatggtactcttcctttcccttgacaggggaggcccaagtgacagatcctttcttagggaaaaagaaggattctatgatatccaaaaagtctgtcctccccaggatgggttcacaaagggcaatccctctagcagatattccaaagacctcaacccagagacaatttaccaatgtggatagggtgagatattcatttttaccttggtacccaccacattccaaatttccttcatggtatcatttagggcacttactgaacctcactgcagaatcactgaggaaaaaaagctctacacattaggttgatacacggtaaggccaggtgtttaaagaacctaattccactttgattcataacaccaaggcctgactttagtccagcaacagtgcttacactcacgttttacagcagggcaacccagaacacgttgacacaaatggatacatgtatagaaatgggttctgtggcctcggtccaggattctcgggagattttcaggaatcacctttcacgttgagtcgggtcctacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatacctacaaaatggtgaggctaaggtcacctgtgatgtggctgttgcttcgagaggaagcagtaaatctttattggaatgccagggttcctttgtgtgtccactgatgtttctctatggtagccaggaagacttgtgtgtgctgggctgggagtaaaacaagaggtaactccaggacagtttctgcacaatgaagttgtacaagtagagctccagaaaaatgtctctctcctcggacctttatttaaagaagggacaacaagggactcgacttctttccctttcctccttagggaagacatacttccaagtatcaagaaagggagcccttgcttccctggaagacatttcgtcccagcaatccctctccagttccatgtgaccattcctactctgagccagttttggaaaggaaggtaagtgattggattaggttaggtgatatccaagtagatgtagccgaattctgtctaggactgggtcaatgatgacaacccaatgtcatgaagaaaagtgatgacataaaattcatgctcaataggattacgctgaggcccaaccagggcgacagggtcacaagaggtccgttgacaccttggggggctctagggtgacttccctgaagtcctcagatgcccttgccctgtttcccatgagaggaaatgtggacatctagggtgcatattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcgtgatttggctttcaattctcagccagtcggtccttttggaattagggataacaaaatggtatacaacggtaccaaaggagctcgatttaggctatgttctccgatgtacatcccctggtttgtaacgtttaaaggaatgtgttcaactcccgataattgttttttcataattttgacctacttctcatggagagaggaggatgacattttttgaatgttgggatctcatactttgatgcttacaattttatggcaaatagctacaggaggacaacactggcctccagggccttatggtactcttcctttcccttgacaggggaggcccaagtgacagatcctttcttagggaaaaagaaggattctatgatatccaaaaagtctgtcctccccaggatgggttcacaaagggcaatccctctagcagatattccaaagacctcaccccagagacaatttaccaatgtggatagggtgagatattcatttttaccttggtacccaccacattccaaatttccttcatggtatcatttagggcacttactgaacctcactgcagaatcactgaggaaaaaaagctctacacattaggttgatacacggtaaggccaggtgtttaaagaacctaattccactttgattcataacaccaaggcctgattttagtccagcaacagtgcttacactcacgttttacagcagggcaacccagaacacgttgacacaaatggatacatgtatagaaatgggttctgtggcctcggtccaggattctcgggagattttcaggaatcacctttcacgttgagtcgggtcctacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatacctacaaaatggtgaggctaaggtcacctgtgatatggctgttgcttcgagaggaagcagtaaatctttattggaatgccagggttccgttgtgtgtccactgatgtttctctatggtagccaggaagacttgtgtatgctgggctggtagtaatacaagaggtaaccccaggacagtttctgcacaatgaagttgtacaagtagagctccagaaaaatgtctctctcctctgacctttatttaaagaagggacaacaagcgtcttgacttctttccctttccactttagggaagacattcttccaagtatcaagaaagggagcccttgcttccctggaagacatttcgtcccagcaatccctctccagttccatgtgaccattcctactctgagccagttttggaaaggaaggtaagtggttggattaggttaggtgatatccaagtagatgtagccaaattctgtctaggactgggtcaatgatgacaacccaatgtcatgaagaaaggtgatgacataaaattcatgctcaataggattacgctgaggcccaaccagggcgacagtgtcacaagaggtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagttggtccttttggaattagggataacaaaatggtatacaacggtaccaaaggagctcgatttaggctatgttctccgatgtacatcccctggtttgtaacgttttaaggaatgtcttcaactcccaataattttttttcataattttgacctacttctcatggagagaggaggatgacattttttgaatgttgggatctcatactttgatgcttacaattttatggcaaatagctacaggaggacaacactggcctccagggccttatggtactcttcctttcccttgagaggggaggcccaagtgacagatcctttcttagggaaaaagaaggattctatgatatccaaaaaggctgtcctccccacgatgggttcacaaagggcaatccctctagcagatattccaaagatctcaccccagagacaatttaccaatgtggatagggtgagatattcatttttaccttggtacccaccacattccaaatttccttcatggtatcatttagggcacttactgaacctcactgcagaatcactgaggaaaaaaagctctacacattaggttgatacacggtaaggccaggtgtttaaagaacctaattccactttgattcataacaccaaggcctgactttagtccagcaacagtgcttacactcacgttttacagcagggcaacccataacacgttgacacaaatggatacatgtatagacatgggttctgtggcctcggtccaggattctcgggagattttcaggaatcacctttcacgttgagtcgggtcttacaacatagaccttacagaggtctgatgccacatttgcactttgagcaaaaacacacagttactttaatcaccctcgaaatacctatctgtagttgttttattcaattatttttttgtcctatccatagaacttgggcaactcaacttgagtgttgatacctacaaaatggtgaggctaaggtgacctgtgatgttgctgttgcttcgagaggaagcagtaaatctttattggaatgccagggttttttgtgtgtccactgatgtttctctatggtagccaggaagacttgtgtgtgctgggctgggagtaatacaagaggtaactccaggacagtttctgcacaatgacgttgtacaagtagagctccagaaaaatgtctctctcctctgacctttatttaacgaagggacaacaagcgactcgaattctttccctttcctccttagggaagacattcttccaagtatcaagaaagggagcccttgcttccctggaagacatttcgtcccagcaatccctctccagttccatgtgaccattcctactctgagccagatttggaaaggaaggtaagtgattggattaggttaggtgatatccaagtagatgtagccgaattctgtctaggactgggtcaatgatgacaacccaatgtcatgaagaaaagtgatgacataaaattcatgctcaataggattacgctgaggcccaaccagggcgacagggtcacaagacgtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcgtgatttggctttcaattctcagccagtcggtccttttggaattagggataacaaaatggtatacaacggtaccaaaggagctcgatttaggctatgttctccgatgtacatcccctggtttgtaacgtttaaaggaatgtgttcaactcccgataattgttttttcataattttgacctacttctcatggagagaggaggatgacattttttgaatgttgggatctcatactttgatgcttacaattttatggcaaatagctacaggaggacaacactggcctccagggccttatggtactcttcctttcccttgacaggggaggcccaagtgacagatcctttcttagggaaaaagaaggattctatgatatccaaaaagtctgtcctccccaggatgggttcacaaagggcaatccctctagcagatattccaaagacctcaccccagagacaatttaccaatgtggatagggtgagatattcatttttaccttggtacccaccacattccaaatttccttcatggtatcatttagggcacttactgaacctcactgcagaatcactgaggaaaaaaagctctacacattaggttgatacacggtaaggccaggtgtttaaagaacctaattccactttgattcataacaccaaggcctgattttagtccagcaacagtgcttacactcacgttttacagcagggcaacccagaacacgttgacacaaatggatacatgtatagaaatgggttctgtggcctcggtccaggattctcgggagattttcaggaatcacctttcacgttgagtcgggtcctacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatacctacaaaatggtgaggctaaggtcacctgtgatatggctgttgcttcgagaggaagcagtaaatctttattggaatgccagggttccgttgtgtgtccactgatgtttctctatggtatccaggaagacttgtgtatgctgggctggtagtaatacaagaggtaaccccaggacagtttctgcacaatgaagttgtacaagtagagctccagaaaaatgtctctctcctctgacctttatttaaagaagggacaacaagcgtcttgacttctttccctttccactttagggaagacattcttccaagtatcaagaaagggagcccttgcttccctggaagacatttcgtcccagcaatccctctccagttccatgtgaccattcctactctgagccagttttggaaaggaaggtaagtggttggattaggttaggtgatatccaagtagatgtagccaaattctgtctaggactgggtcaatgatgacaacccaatgtcatgaagaaaggtgatgacataaaattcatgctcaataggattacgctgaggcccaaccagggcgacagtgtcacaagaggtccgttgactccttggggggctctagggtgacttccctgaagtcctcagatgccctttccctgtttcccatgagaggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaattagggataacaaaatggtatacaacggtaccaaaggagctcgatttaggctatgttctccgatgtacatcccctggtttgtaacgttttaaggaatgtcttcaactcccaataattttttttcataattttgacctacttctcatggagagaggaggatgacattttttgaatgttgggatctcatactttgatgcttacaattttatggcaaatagctacaggaggacaacactggcctccagggccttatggtactcttcctttcccttgagaggggaggcccaagtgacagatcctttcttagggaaaaagaaggattctatgatatccaaaaaggctgtcctccccacgatgggttcacaaagggcaatccctctagcagatattccaaagatctcaccccagagacaatttaccaatgtggatagggtgagatattcatttttaccttggtacccaccacattccaaatttccttcatggtatcatttagggcacttactgaacctcactgcagaatcactgaggaaaaaaagctctacacattaggttgatacacggtaaggccaggtgtttaaagaacctaattccactttgattcataacaccaaggcctgactttagtccagcaacagtgcttacactcacgttttacagcagggcaacccataacacgttgacacaaatggatacatgtatagacatgggttctgtggcctcggtccaggattctcgggagattttcaggaatcacctttcacgttgagtcgggtcttacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatacctacaaaatggtgaggctaaggtgacctgtgatgttgctgttgcttcgagaggaagcagtaaatccttatttgaatgccagggttttttgtgtgtccactgatgtttctctatggtagccaggaagacttgtgtgtgctgggctgggagtaatacaagaggtaactccaggacagtttctgcacaatgacgttgtacaagtagagctccagaaaaatgtctctctcctctgacctttatttaacgaagggacaacaagcgtcttgacttctttccctttccactttagggaagacattcttccaagtatcaagaaagggagcccttgcttccctggaagacatttcgtcccagcaatccctctccagttccatgtgaccattcctactctgagccagttttggaaaggaaggtaagtggttggattaggttaggtgatatccaagtagatgtagccaaattctgtctaggactgggtcaatgatgacaacccaatgtcatgaagaaaggtgatgacataaaattcatgctcaataggattacgctgaggcccaaccagggcgacagtgtcacaagaggtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaattagggataacaaaatggtatacaacggtaccaaaggagctcgatttaggctatgttctccgatgtacatcccctggtttgtaacgttttaaggaatgtcttcaactcccaataattttttttcataattttgacctacttctcatggagagaggaggatgacattttttgaatgttgggatctcatactttgatgcttacaattttatggcaaatagctacaggaggacaacactggcctccagggccttatggtactcttcctttcccttgagaggggaggcccaagtgacagatcctttcttagggaaaaagaaggattctatgatatccaaaaaggctgtcctccccacgatgggttcacaaagggcaatccctctagcagatattccaaagatctcaccccagagacaatttaccaatgtggatagggtgagatattcatttttaccttggtacccaccacattccaaatttccttcatggtatcatttagggcacttactgaacctcactgcagaatcactgaggaaaaaaagctctacacattaggttgatacacggtaaggccaggtgtttaaagaacctaattccactttgattcataacaccaaggcctgactttagtccagcaacagtgcttacactcacgttttacagcagggcaacccataacacgttgacacaaatggatacatgtatagacatgggttctgtggcctcggtccaggattctcgggagattttcaggaatcacctttcacgttgagtcgggtcctacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatacctacaaaatggtgaggctaaggtcacctgtgatgtggctgttgcttcgagaggaagcagtaaatctttattggaatgccagggttcctttgtgtgtccactgatgtttctctatggtagccaggaagacttgtgtgtgctgggctggtagtaatataagaggtaaccccaggacagtttctgcacaatgaagttgtacaagtagagctccagaaaaatgtctctctcttctgacctttatttaaagaatggacaacaagcgtcttgacttctttcccgttcctccttagggaagacattcttccaagtatcaagaaagggagcccttgcttccctggaagacatttcgtcccagcaatcactctccagttccttgtgaccattcctattctgagccagttttggaaaggtaggtaagtggttggattaggttaggtgatttccaagtagaggtagccgaattctgtctaggactgggtcaatgatgacaacccaatgtcatgaagaaaggtgatgacataaaattcatgctcaataggattacgctgaggcccaaccagggcgacagggtcacaagaggtccgttgactccttggggggctctagggtgacttccctgaagtcctcagatgccctttccctgtttcccatgataggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaattagggataacaaaatggtatacaacggtaccaaaggagctcgatttaggctatgttctccgatgtacatcccctggtttttaacgttttaaggaatgtgttcaactcccgataattgttttttcataattttgacctacttctcatggagagaggaggatgacattttttgaatgttgggatctcatactttaatgcttacaattttatggcaaatagctacaggaggacaacacttgcctccagggccttatggtactcttcctttcccttgacaggggaggcccaagtgacagatcctttcttagggaaaaagaaggattctatgatatccaaaaaggctgtcctccccacgatgggttcacaaagggcaatccctctagcagatattccaaagatctcaccccagagacaatttaccaatgtggatagggtgagatattcatttttaccttggtacccaccacattccaaatttccttcatggtatcatttagggcacttactgaacctcactgcagaatcactgaggaaaaaaagctctacacattaggttgatacactgtaaggccaggtgtttaaagaacctaattccactttgattcataacaccaaggcctgactttagtccagcaacagtgcttacactcacgttttacagcagggcaacccataacacgttaacacaaatggatacatatatagacatgggttctgtggcctaggtccaggattctcgggagattttcaggaatcacctttcacgttgagtcgggtcttacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatacctacaaaatggtgaggctaaggtcacctgtgatgtggctgttgcttcgagaggaagcagtaaatctttattggaatgccagggttcctttgtgtgtccactgatgtttctctatggtagccaggaagacttgtgtgtgctgggctggtagtaatacaagaggtaaccccaggacagtttctgcacaatgaagttgtacaagtagagctccagaaaaatgtctctctcctctgacctttatttaaagaagggacaacaagcgtcttgacttctttcccgttcctccttagggaagacattcttccaagtatcaagaaagggagcccttgcttccctggaagacatttcgtcccagcaatcactctccagttccttgtgaccattcctactctgagccagttttggaaaggtaggtaagtggttggattaggttaggtgatttccaagtagaggtagccgaattctgtctaggactgggtcaatgatgacaacccaatgtcatgaagaaaggtgatgacataaaattcatgctcaataggattacgctgaggcccaaccagggcgacagtgtcacaactggtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaattagggataacaaaatagtatacaacggtaccaaaggagctcgatttaggctatgttctccgatgtacatcccctggtttgtaacgttttaaggaatgtgttcaactcccgataattgttttttcataattttgacctacttctcatggagagaggaggatgacattttttgaatgttgggatctcatactttgatgcttacaattttatggcaaatagctacaggaggacaacactggcctccagggccttatggtactcttcctttcccttgacaggggaggcccaagtgacagatcctttcttagggaaaaagaaggattctatgatatccaaaaagtctgtcctccccaggatgggttcacaaagggcaatccctctagcagatattccaaagatctcaccccagagacaatttaccaatgtggatagggtgagatattcatttttaccttggtacccaccacattccaaatttccttcatggtatcatttagggcacttaatgaacctcactgcagaatcactgaggaaaaaaagctctacacattaggttgatacagggtaaggccaggtgtttaaagaatctaattccactttgattcataacaccaaggcctgactttagtccagcaacagtgattacactcacgttttacagcagggcaacccataacacgttgacacaaatggatacatgtatagacatgggttctgtggcctcggtccaggattctcgggagattttcaggaatcacctttcacgttgagtcgggtcctacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatacctacaaaatggtgaggctaaggtcacctgtgatgtggctgttgcttcgagaggaagcagtaaatctttattggaatgccagggttcctttgtgtgtccactgatgtttctctatggtagccaggaagacttgtgtgtgctgggctggtagtaatacaagaggtaaccccaggacagtttctgcacaatgaagttgtacaagtagagctccagaaaaatgtctctctcctctgacctttatttaaagaatggacaacaagcgtcttgacttctttcccgttcctccttagggaagacattcttccaagtatcaagaaagggagcccttgcttccctggaagacatttcgtcccagcaatcactctccagttccttgtgaccattcctactctgagccagttttggaaaggtaggtaagtggttggattaggttaggtgatttccaagtagtggtagccgaattctgtctaggactgggtcaatgatgacaacccaatgtcatgaagaaaggtgatgacataaaattcatgctcaataggattacgctgaggcccaaccagggcgacagggtcacaactggtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaattagggataacaaaatagtatacaatggtaccaaaggagctcgatttaggctatgttctccgatgtacatcccctggtttgtaacgttttaaggaatgtgttcaactcccgataattgttttttcataattttgacctacttctcatggagagaggaggatgacattttttgaatgttgggatctcatactttgatgcttacaattttatggcaaatagctacaggaggacaacactggcctccagggccttatggtactcttcctttcccttgacaggggaggcccaagtgacagatactttcttagggaaaaagaaggattctatgatatccaaaaaggctgtcctccccaggatgggttcacaaagggcaatccctctagcagatattccaaagatctcaccccagagacaatttaccaatgtggatagggtgagaaattcatttttaccttggtacccaccacattccaaatttccttcatggtatcatttagggaacttactgaacctcactgcagaatcactgaggaaaaaaagctctacacattaggttgatacagggtaaggccaggtgtttaaagaatctaattccactttgattcataacaccacggcctgactttagtccagcaacagtgcttacactcacgttttacagcagggcaacccataacacgttgacacaaatggatacatgtatagacatgggttctgtggcctcggtccaggattctcgggagattttcaggaatcacctttcacgttgagtcggatcctacaacatagaccttacagaggtctgatgccacatttgcactttgagcaaaaacacacagttactttaatcaccctcgaaatacctatttgtagttgttttattcaattatttttttgtcctatccatagaacttgggcagctcaacttgagtgttgatacctacaaaatggtgaggctaaagtcacctgtgatgtggctgttgcttcgagaggaagcagtaaatctttattggaatgccagggttcctttatgtgtccactgatgtttctctatggtagccaggaagacttgtgtgtgctgggctggtagtaatacaagaggtaaccccaggacagtttctgcacaatgaagttgtacaagtagagctccagaaaaatgtctctctcctctgaccttaatttaaagaagggacaacaagcgtcttgacttctttccctttcctgcttagggaagacattcttccaagtatcaagaaagggagcccttgcttccctggaagacattttgtcccagcaatccctctccagttccatgtgaccattcctactctgagccagttttggaaaggaaggtaagtggttggattaggttaggtgatatccaagtagaggtagccgaattctgtccaggactgggtcaatgatgacaacccaatgtcatgaagaaaggtgatgacataaaattaatgctcaataggattacgctgaggcccaaccagggcgacagtgtcacaactggtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaatatggtaaagcctccacatccaggtgacctcccccttcatgatttggctttcaattctcagccagtcggtccttttggaattggggataacaaaatggtatacaacggtaccaaaggagctcgatttaggctatgttctccgatgtacatcccctggtttgtaacgttttaaggaatgtgttcaactcccgataattgttttttcttaattttgacctacttctcatggagagaggaggatgacattttttgaatgttgggatctcatactttgatgcttacaattttatggcaaatagctacaggaggacaacactggcctccagggccttatggtattcttcctttcccttgacaggggaggcccaagtgacagatcctttcttagggaaaaagaaggattctatgatatccaaaaaggctgtcctccccacgatgggttcacaaagggcaatccctctagcagatattccaaagatctcaccccagagacaatttaccaatgtggatagggtgagatattcatttttaccttggtacccaccacattccaaatttccttcatggtatcatttagggcacttactgaacctcactgcagaatcactgaggaaaaaaagctctacacattaggttgatacactgtaaggccaggtgtttaaagaacctaattccactttgattcataacaccaaggcctgactttagtccagcaacagtgcttacactcacgttttacagcagggcaacccataacacgttaacacaaatggatacatatatagacatgggttctgtggcctaggtccaggattctcgggagattttcaggaatcacctttcacgttgagttgggtcttacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatacctacaaaatggtgaggctaaggtcacctgtgatgtggctgttgcttcgagaggaagcagtaaatctttattggaatgccagggttcctttgtgtgtccacagatgtttctctatggtagccaggaagacttgtgtgtgctgggctggtagtaatacaagaggtaaccccaggacagtttctgcacaatgaagttgtacaagtagagctccagaaaaatgtctctctcctctgacctttatttaaagaagggacaacaagcttcttgacttctttccctttcctccttagggaagacattcttccaagtatcaagaaagggagcccttgcttccctggaagacatttcgtcccagcaatccctctccagttccatgtgaccattcctactctgagccagttttggaaaggaaggtaagtgtttggattaggttaggtgatatccaagtagatgtagccgaattctgtctaggactgggtcaatgatgcaacccaatgtcatgaagaaagttgatgacataaaattcatgctcaataggattacgctgaggcccaaccagggcgacagggtcacaagaggtccgatgactccttggggggctctagggtgaattccctgaagtcctcagatgcacttgccctgtttcccatgagaggaaatgtggacatctagggtgcacattggttggcaaacactgcatgccaacaagcacctagtcccacaatggaaccttgggcatttctgcaaggatcgccccttgttcatgacaatgtcttttctggtgttttgcagtcatctcacatgccaccttggaaggcagagaaacacagataatcaggtaagtggtcagaacatggtaaagccttcacatccaggtgacttcccccttcatgatttggctttcaattctcagccagtcggtccttttggaatttggggataacaaaatggtatgcaaaggtaccaaaggagctcgatttaggctatgttctccgatgtacatcccctggtttgtaacgttttaaggaatgtgttcaactcccgataattgttttttcataattttgacctacttctcatggagagaggaggatgacattttttgaatgttgggatctcatactttgatgcttacaattttatggcaaatagctacaggaggacaacactggcctccagggccttatggtattcttcctttcccttgacaggggaggcccaagtgacagatcctttcttagggaaaaagaaggattctatgatatccaaaaaggctgtcctccccacgatgggttcacaaagggcaatccctctagcagatattccaaagatctcaccccagagacaatttaccaatgtggatagggtgagatattcatttttaccttggtacccaccacattccaaatttccttcatggtatcatttagggcacttactgaacctcactgcagaatcactgaggaaaaaaagctctacacattaggttgatacactgtaaggccaggtgtttaaagaacctaattccactttgattcataacaccaaggcctgactttagtccagcaacagtgcttacactcacgttttacagcagggcaacccataacacgttaacacaaatggatacatatatagacatgggttctgtggcctaggtccaggattctcgggagattttcaggaatcacctttcacgttgagtcgggtcttacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatacctacaaaatggtgaggctaaggtcacctgtgatgtggctgttgcttcgagaggaagcagtaaatctttattggaatgccagggttcctttgtgtgtccacagatgtttctctatggtagccaggaagacttgtgtgtgctgggctggtagtaatacaagaggtaaccccaggacagtttctgcacaatgaagttgtacaagtagagctccagaaaaatgtctctctcctctgacctttatttaaagaagggacaacaagcttcttgacttctttcccgttcctccttagggaagacattcttccaagtatcaagaaagggagcccttgcttccctggaagacatttcgtcccagcaatccctctccagttccatgtgaccattcctactctgagccagttttggaaaggaaggtaagtgtttggattaggttaggtgatatccaagtagatgtagccgaattctgtctaggactgggtcaatgatgcaacccaatgtcatgaagaaagttgatgacataaaattcatgctcaataggattacgctgaggcccaaccagggcgacagggtcacaagaggtccgttgactccttggggggctctagggtgacttccctgaagtcctcagatgcacttgccctgtttcccatgacaggaaatgtggacatctagggtgcacattggttggcaaacactgcatgccaaaaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagccttcacatccaggtgacttcccccttcatgatttggctttcaattctcagccagtcggtccttttggaatttggggataacaaaatggtatgcaaaggtaccaaaggagctcgatttaggctatgttctccgatgtacatcccctggtttgtaacgttttatggaatgtgttcaactcccgataattgttttttcataattttgacctacttctcatggagagaggaggatgacattttttgaatgttgggatctcatactttgatgcttacaattttatggcaaatagctacaggaggacaacactggcctccagggccttatggtactcttcctttcccttgacaggggaggcccaagtgacagatcctttcttagggaaaaagaaggattctatgatatccaaaaagtctgtcctcgccaggatgggttcacaaagggcaatccctctagcagatattccaaacatctcaccccagagacaatttatcaatgtggatatggtgagatattcatttttaccttggtacccaccacattccaaatttccttcatggtatcatttagggcacttactgaacctcactgcagaatcactgaggaaaaaaagctctacacattaggttgatacagggtaaggccaggtggttaaagaaccttattccactttgattcataacaccaaggcctgactttagtccagcaacagtgcttacactcacgttttacagcagggcaacccataacacgttgacacaaatggttccatgtatagacatgggttctgtggcctcggtccaggattctcgggagattttcaggaatcacctttcacgttaatcgggtcttacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatacctacaaaatggtgaggctaaggtcacctgtgatgtggctgttgcttcgagaggaagcagtaaatctttattggaatgccagggttcctttgtgtgtccactgatgtttctctatggtagccaagaagacttgtgtatgctgggctggtagtaatacaagaggtaaccccaggacagtttctgcacaatgaagttgtacaagtagagctccagaaaaatgtctctctcctctgacctttatttaaagaagggacaacaagcttcttgacttctttcccgttcctccttagggaagacattcttccaagtatcaagaaagggagcccttgcttccctggaagacatttcgtcccagcaatccctctccagttccatgtgaccattcctactctgagccagttttggaaaggaaggtaagttgttggattaggttaggtgatatccaaatataggtagccgaattctgtctaggactgggtcaatgatgacaacccaatgtcatgaagaaaggtgatgacataaaattcatgctcaataggattacgctgaggcccaaccagggcgacagggtcacaagtggtccgttgactccttgggggtctctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaatttggggataacaaaatggtatgcaaaagtaccaaaggagctcgatttaggctatgttctccgatgtacatcccctggtttgtaacgtttaaaggattgtgttcaactcccgataattgttttttcataattttgacctacttctcatggagagaggaggatgacattttttgaatgttgggatctcatactttgatgcttacaattttatggcaaatagctacaggaggacaacactggcctccagggccttatggtactcttcctttcccttgacaggggaggcccaagtgacagatcctttcttagggaaaaagaaggattctatgatatccaaaaaggctgtcctccccacgatgggttcacaaagggcaatccctctagcagatattccaaagatctcaccccagagacaatttaccaatgtggatatggtgagatattcattattaccttggtacccaccacattccaaatttccttcatggtatcatttagggcacttactgaacctcactgcagaatcactgaggaaaaaaagctctacacattaggttgatacagggtaaggccaggtgtttaaagaacctaattccactttgattcataacaccaaggcctgactttagtccagcaacagtgcttacactcacgttttacagcagggcaacccaaaacacgttgacacaaatggatacatgtatagacatgggttctgtggccttggtccaggattctcgggagattttcaggaatcacctttcacattgagtcgggtcctacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatacctacaaaatggtgaggctaaggtcacctgtgatgtggctgttgcttcgagaggaagcagtaaatctttattggaatgccagggttcctttgtgtgtccactgatgtttctctatggtagccaggaagacttgtgtatgctgggctggtagtaatacaagaggtaaccccagggcagtttctgcacaatgaagttgtacaagtagagctccagaaaaatgtctctctcctctgacctttatttaaagaagggacaacaagcttcttgacttctttccctttcctccttagggaagacattcttccaagtatcaagaaagggagcccttgcttccctggaagacatttcgtcccaggaatccctctccagatccatgtgaccattcctactctgagccagttttggaaagtaaggtaagtggttggattaggttaggtgatatccaagtagaggtagccgaattctgtctaggactgggtcaatgatgacaaccaaatgtcatgaagaaagttgatgacataaaattcatgctcaataggattactctgaggcccaaccagggtgacagggtcacaggaggtccgttgactccttggggggctctagggtgatttccctgaagtcctcagatgccctttccctgtttcccatgagaggaaatgtggccatctagggagcacattggttggcaaacactgcatgccaacaagcacctagtcccacaatggaaccttgggcatttctgcaaggatcgccccttgctcatgacaatgtcttttctggtgttttgcagtcatctcacattccaccttggaaggcagagaaacacagataatcaggtaagtggtcagaacatggtaaatcctccacatccaggtgacctcccccttcatgatttggctttcaattctcagccagtcggtccttttggaattagggataacaaaatggtatacaacggtaccaaaggagctcgatttaggctatgttctccgatgtacatcccctggtttttaacgttttaaggaatgtgttcaactcccgataattgttttttcataattttgacctacttctcatggagagaggaggatgacattttttgaatgttgggatctcatactttgatgctttcaattttatggcaaataggtacaggaggacaacactgtcctccagggccttatggtactcttcctttcccttgaaaggggaggcccaagtaacagatcctttcttagggaaaaagaaggattctatgatatccaaaaaggctgtcctacccaggatgggttcacaaagggcaatccctctagcagatattccaaagatctcaccccagagacaatttaccaatgtggatatggtgagatattcatttttacctttgtacccaccacattccaaatttccttcagggtatcatttagggcacttactgaacctcactgcagaatcactgaggaaaaaaagctctacacattaggttgatacagggtaaggccaggtgtttaaagaacctaattccactttgattcataacaccaaggcctgactttagtccagcaacagtgcttacactcacgttttacagcagggcaacccaaaacacgttgacacaaatggatacatgtatagacatgggttctgtggcctcggtccaggattctcgggagattttcaggaatcacctttcacgttgaatcgggtcctacaacatagaccttacagaggactgatgccacatttgcactttgagcaaaaacacacagttactttaatcaccctcgaaatacctatctgtagttgttttattcaattatttttttgtcctatccatagaacttgggcagctcaacttgagtgttgatacctacaaaatggtgaggctaaggtcacctgtgatgtggctgttgcttcgagaggaagcagtaaatctttattggaatgccagggttcctttgtgtgtccactgatgtttctctatggtagccaggaagacttgtgtgtgctgggctggtagtaatacaagaggtaaccccaggacagtttctgcccaatgaagttgtacaagtagagctccagaaaaatgtctctctcctctgacctttatttaaagaagggacaacaagcgtcttgacttctttccctttcctccatagggaagacattcttccaagtatcaagaaagggagcccttgcttccctggaagacatttcatcccagcaatccctctccagttccatgtgaccattcctactctgagccagttttggaaaggaaggtaagtggttggattaggttatgtgatatccaagtagaggtagccgaattctgtctaggactgggtcaatgatgacaacccaatgtcatgaagaaaggtgatgacataaaattcatgctcaataggattacactgaggcccaaccagggcgacagggtcacaagaggtccgttgactccttggggggctctagggtgacttccctgaagtcctcatatgcccttgccctgtttcccatgagaggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcattccttttggaattagggataacaaaatggtatacaaaggtaccaaaggagctcgatttaggctatgttctccgatgtacatcccctggtttgtaacgttttaaggaatgtgttcaactcccgataattgttttttcataattttgacctacttcttatggagagaggaggatgacattttttgaatgttgggatctcatactttgatgcttacaattttatggcaaatagctacaggaggacaacactggcctccagggccttatggtacccttcctttcccttgacaggagaggcccaagtgaccgatcctttcttagggaaaaagaaggattctatgatatccaaaaaggctgtcctccccaggatgggttcacaaagggcaatccctctagcagatattccaaagatctcaccccagagacaatttaccaatgtggatatggtgagatattcatttttacctttgtacccaccacattccaaatttccttcagggtatcatttagggcacttactgaacctcactgcagaatcactgaggaaaaaaagctctacacattaggttgatacagggtaaggccaggtgtttaaagaacctaattccactttgattcataacaccaaggcctgactttagtccagcaacagtgcttacactcacgttttacagcagggcaacccaaaacacgttgacacaaatggatacatgtatagacatgggttctgtggcctcggtccaggattctcgggagattttcaggaatcacctttcacgttgaatcgggtcctacaacatagaccttacagaggactgatgccacatttgcactttgagcaaaaacacacagttactttaatcaccctcgaaatacctatctgtagttgttttattcaattatttttttgtcctatccatagaacttgggcagctcaacttgagtgttgatacctacaaaatggtgaggctaaggtcacctgtgatgtggctgttgcttcgagaggaagcagtaaatctttattggaatgccagggttcctttgtgtgtccactgatgtttctctatggtagccaggaagacttgtgtgtgctgggctggtagtaatacaagaggtaaccccaggacagtttctgcccaatgaagttgtacaagtagagctccagaaaaatgtctctctcctctgacctttatttaaagaagggacaacaagcgtcttgacttctttccctttcctccatagggaagacattcttccaagtatcaagaaagggagcccttgcttccctggaagacatttcatcccagcaatccctctccagttccatgtgaccattcctactctgagccagttttggaaaggaaggtaagtggttggattaggttatgtgatatccaagtagaggtagccgaattctgtctaggactgggtcaatgatgacaacccaatgtcatgaagaaaggtgatgacataaaattcatgctcaataggattacactgaggcccaaccagggcgacagggtcacaagaggtccgttgactccttggggggctctagggtgacttccctgaagtcctcatatgcccttgccctgtttcccatgagaggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcattccttttggaattagggataacaaaatggtatacaaaggtaccaaaggagctcgatttaggctatgttctccgatgtacatcccctggtttgtaacgttttaaggaatgtgttcaactcccgataattgttttttcataattttgacctacttcttatggagagaggaggatgacattttttgaatgttgggatctcatactttgatgcttacaattttatggcaaatagctacaggaggacaacactggcctccagggccttatggtacccttcctttcccttgacaggagaggcccaagtgaccgatcctttcttagggaaaaagaaggattctatgatatccaaaaaggctgtcctccccaggatgggttcacaaagggcaatccctctagcagatattccaaagatctcaccccagagacaatttaccaatgtggatagggtgagatattcatttttaccttggtacccaccacattccaaatttccttcatggtatcatttagggcacttactgaacctcactgcagaatcactgaggaaaaaaagctctacacattaggttgatacagggttaggccaggtgtttaaagaacctaattccactttgattcataacaccaaggcctgactttagtccagcaacagtgcttacactcacgttttacagcagggcaacccataacacgttgacacaaatggatacatgtatagacatgggttctgtggcctcggtccaggattctcgggagattttctggaatcacctttcacgttgagtcgggtcgtacaacacagaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatacctacaaaatggtgaggctaaggtcacctgtgatgtggctgttgcttcgagagcaagcagtaaatctttattagaatgccagggttcctttgtctgtccactgatgtttctttatggtagccaggaagacttgtgtgtgctgggctggtagtaatacaagaggtaaccccaggacagtttctgcacaatgaagttgtacaagtagagctccagaaatatgtctctctcctctgacctttatttaaagaagggacaacaagcgtctttacttctttccctttccactttagggaagacattcttccaagtatcaagaaagggagcccttgcttccctggaagacatttcgtcccagcaatccctctccagttccatgtgaccattcctactctgagccagttttggaaaggaaggtaagtggttggattaggttaggtgatatccaagtagttgtagccaaattctgtctaggactgggtcaatgatgacaacccaatgtcatgaagaaagttgatgacataaaattcatgctcaataggattacgctgaggcccaaccagagcgacagggtcacaagaggtccgttgactccttgggctgctctagggtgacttccatgaagtcctcaggtgcccttgccctgtttcccatgagaggaaatgtggacatctagggtgcacattggttggcaaacactgcatgccaacaagcacctagtcccacaatggaaccttgggcatttctgcaaggatcgcccctttctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaatttggggataacaaaattgtatgcaaaggtaccaaaggagctcgatttaggctatgttctccgatgtacatcccctggtttgtaacgttttaaggaatgtgttcaactccccataattgttttttcataattttgacctacttctcatggagagaggaggatgacattttttgaatgttgggatctcatactttgatgcttacaattttatggcaaatagcttcaggaggacaacactggcctccagggccttatggtactcttcctttcccttgacaggggaggcccaagtgacagatcctttcttagggaaaaagaaggattctatgatatccaaaaagtctgtcctcgccaggatgggttcacaaagggcaatccctctagcagatattccaaacatctcaccccagagacaatttatcaatgtggatatggtgagatattcatttttaccttggtacccaccacattccaaatttccttcatggtatcatttagggcacttactgaacctcactgcagaatcactgaggaaaaaaagctctacacattaggttgatacagggtaaggccaggtgtttaaagaacctaattccactttgattcataacaccaaggcctgactttagtccagcaacagtgcttacactcacgttttacagcagggcaacccataacacgttgacacaaatggatccatgtatagacatgggttctgtggcctcagtccaggattctcgggagattttcaggaatcacctttcacgttgactcgggtcgtacaacatagacattacagaggtctgatgccacatttacactttgagcaaaaacacacagttactttaatcaccctcgaaatacctatctgtagtttttttattcaattatttttttgtcctatccatagaacttgggcagctcaacttgagtgttgatacctacaaaatggtgaggctaaggtcacctgtgatgtggctgttgcttcgagaggaagcagtaaatctttattggaatgccagggttcctttgtgtgtccactgaagtttctctatggtagccaggaagacttgtgtgtgctgggctggtagtaaccccaggacagtttctgcacaatgaagttgtacaagtagagctccagaaaaatgtctctctcctctgacctttatttaaagaagggacaacaagtgccttgacttctttccctttcctccttagggaagacattcttccaagtatcaagaaagggagaccttgcttccctggaagacattttgtcccagcaattcctctccagtttcatgtgaccattcctactctgagccagttttggaaatgaaggtaagtggttggattaggttaggtgatatccaagtagatgtagccgaattctgtctaggactgtgtcaatgatgacaacccaatgtcatgaagaaaggtgatgacataaaattcatgctcaataggattacgctgaggcccaaccagggcgacagggtcacaagaggtccgttgactccttggggggctctagggtgacttccctgaagtcctcagatgcccttgccctgtttcccatgagaggaaatgtggacatctagggtgcacattggttggcaaacacttcatgccaacaagcacctagtcccacaatggaaccttgggcatttctgcaaggatcgccccttgttcatgacaatgttttttctggtgttttgcagtcatctcacatgccaccttggaaggcagagcaacacagataatcaggtaagtggtcagaacatggtaaagcctccacatccaggtgacctcccccttcatgatttggctttcaattctcagcctgtcggtccttttggaattagggataacaaaatggtatacaacggtaccaaaggagctcaatttaggctatgttctccgatgtacatcccctggtttgtaacgttttaaggaatgtgttcaactcccgataattattttttcataattttgacctacttctcatggagagaggaggatgacattttttgaatgttgggatctcatactttgatgcttacaattttatggcaaatagctacaggaggacaacactggcctccagggccttatggtactcttcctttcccttgacaggggaggcccaagtgacagatcctttcttagggaaaaagaaggattctatgatacccaaaaaggctgtcctcgccaggatgggttcacaaagggcaatccctctagcagatattccaaagatctcaccccagagacaatttaccaatgtggatagggtgagatattcatttttaccttggtacccaccacattccaaatttccttcatggtatcatttagggtacttaatgaacctcactgcagaatcactgaggaaaaaaagctctacacattaggttgatacagggtaaggccaggtgtttaaagaacctaattgcactttgattcataacaccaaggcctcacttgagtccagcaacagtggttaccctcacgttttacagcagggcaacccataacaccttgacacaaatggatccatgtatagacatgggttctgtggcctgggcccaggattctcgggagattttcaggaatcacctttcacgttgagttgggtcttacaacatagaccttacagaggtctgatgccacatttgcactttgagcaaaaacacacagttactttaatcaccctcgaaatacctatctgtagttgttttattcaattatttttttgtcttatccataacttgggcagctcaacttgagtgttgatacctacaaaatggtgaggctaagttcacctgtgatgtggctgttgctttgagaggaagcagtaaatcttattggaatgccagtgttcctttgggtgtccactgatgtttctctatggtagccaggaagacttgtgtatgctgggctggtaatacaagaggtaaccccaggacagtttctgcacaatgaagttgtacaagtagagctccagaaaaatgtctctctcctctgacctttatttaaagatgggacaaccagcgtcttgacttctttccctttcctccttagggaagacattcttccaagtatcaagaaagggagcccttgcttccctggaagacatttcgtcccagcaatccctctccagttccatgtgaccattcctactctgagccagttttggaaaggaatgtaagtggttggattaggttaggtgatatccaagtagaggtagccgaattctgtccaggactgggtcaatgatgacaacccaatgtcatgaagaaaggtgatgacataaaattcatgctcaataggattacgctgaggcccaaccagggcgacagggtcactagaggtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaatttggggataacaaaatggtatgcaaaggtaccaaaagagctcgatttaggctatgttctccgatgtacatcccctggtttgtaacgttataaggaatgtgttcaactcccgataattgttttttcataattttgacctacttttcatggagagaggagcatgacattttttgaatcttaggatctcatactttgatgcttacaattttatggcaaataggtacaggaggacaacacaggcctccagggccttatgagactcttcctttcccttgacaggggaggcccaagtgacagagcctttcttagggaaaaagaaggattttatgatatccaagaagggtgtcctccccaggatgggttcacaaagggcaatcactctagcagatattctaaagatctcaccccagagacaatttacccatgtggaaagggtgagatattcatttttaccttggtacccaccacattccaaattttcttcatggtatcatttagggcacttactgaacctcactgcagaatcacttaggaaaaatagctctacacattaggttgatacagggtaaggccaggtgtttaaagaacctaattccactttgattcataacaccaaggcctgactttagtccagcaacagtgcttacactcacgttttacagcagggcaacccataacacgttgacacaaatggatacatgtatagacatgggttctgtggcctcggtccaggattctcgggagattttcaggaatcacctttcacgttgagtcgggtcctacaacatagaccttacagaggtctgatgccacatttgcactttgagcaaaacacacagttactttaatcaccctcgaaatacctatctgtagttgttttattcaattattttttgtcttatccatagaacttgggcagctcaacttgagtgttgatacctacaaaatggtgaggctaaggtcacctgtgatgtggctgttgcttcgagaggaagcagtaaatcttattggaatgccagggttccattgtgtgtccactgatgtttctctatggtagccaggaagacttgtgtatgctgggctggtagtaatacaagaggtaaccccaggacagtttctgcacaatgaagttgtacaagtagagctccagaaaaatgtctctctcctctgacctttatttaaagaagggacaacaagtgtcttgacttctttccctttcctccttagggaagacattcttccaagtatcaagaaagggagcacttgcttccctggaagacatttcatcccagcaatccctctccagttccatatgaccattcctactccgagccagttttggaaaggaaggtaagtggttggattaggttaggtgatatccaagtagaggtagccgaattctatctaggactgggtcaatgatgacaacccaatatcatgaagaaaggtgatgacataaaattcatgctcaataggtttacgctgaggcccaaccagggcgacagggtcacaagaggtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagcaacacagataatcaggtaagtggtcagaacatggtaaagcctccacatccaggtgacctcccccttcatgatttggctttcaattctcagccagtcagtccttttggaattagggataacaaaatggtatacaatggtaccaaaggagctcgatttaggctatgttctccgatgtacatcccctggtttgtaacgttttaaggaatgtgttcaactcccgataattgttttttcataattttgacctacttctcatggagagaggaggatgacattttttgaatgttggaatctcatactttgatgcttacaattttatggcaaatagctacaggaggacaacactggcctccagggccttatggtactcttcctttcccttgacaggggaggcccaagtgacagatactttcttagggaaaaagaaggattctatgatatccaaaaaggctgtcctccccaggatgggttcacaaagggcaatcccaaagatctcaccccagagacaatttaccaatttggatagggtgagatattcatttttaccttggtactcaccacattccaaatttccttcatggtatcatttagggcacttactgaacctcactgcagaatcactgaggaaaaaaagctctacacattaggttgatacagggtaaggccaggtgtttaaagaacctaattccactttgattcataataccaaggcctgactttagtccagtatctgtgcttacactcatgttttacagcagggcaacccataacatcttaaatgcgttctcatgaccagccaggaagaacacaacaaatcagaatcttctgcggcaaaactttattgcttacatcttcaggagccaggagcgcaagccccaagccccaaaaacgaaaggcccccgcttacatctttaggaaccagagcgccagtgcgccagagcgccagcgcgccagagcaaaagcgcaagagcgcaagtaagagagagaatggcgggaaccccgtccccttttaaggagaattatccttcacctaggacgcatcactccctgtttggctgcagcccatggccgagtaaaggcagagtacatgtagtggaaaattactcttggcacatgcgcagattatttgtttaccacttagaacacaggatgtcagcgccatcttgtgacggcgaatgtgggggtggctcccaacatctccccctttccttttaataagagcaataggccacccatattaatgagagtggagatagaggtcaaatccccagtgtgcaagtaaaggagccatgtacatgcttagctcttaggctcacaggcttttacccagagcaaccctgacctgctcccgtgtcgttttgcctggagagaaggacacttggacactcaaccttcttgcaagatgacatgtctccctagaataggctcatatatgccgcagagcccttctactgcagtgcttagccgtgcaactctctcaggctgctgaagcacactcactctatctcgtgcaatgagtctagcctcgtgggatgtaagagctgagtggccagcgacctattgcctaagcatagatatattaggggaagcaccatgttctagagctgtaagtgtctaggcaataaccaccttgtctctcctagtttgggccttaagcttacagaccaaccaaagaagcaacactaatccacagcaaagtgtatctccaaataatatcaatcccacccattctttaaagaagggaaatgctgaggagatccaattgggtaatcctttagtcagggacaggtccaagcgcgtggagttgacctgaagtctcaattcccgaaagatctgttcaaattcagccgtccaattctgtaacatatactgaaaaagactttttgacaaattagctgccctagtaaaattctcatactgaatggaagtaatggacaatcccggaaacttttgttcacatcccagctgagttatttgccataatacatctagttgtttctggacaagatctatgagttgattaaccagcatgagaccaccctgtatcttgacattagctgaggcctgtttatctatgactgtagtcactgaggctgacaaagtgttaatggtgtcagtcgtctggacctgtccagacagagccaaggctgtctgaatcaaggccaaacccagttcctagttagtggtaaaaaagcaggggaatacttgagcattatacatcaccgtcattaggagtggaaatgtcgacattatcccccaacgctgctctctctttattattgacgccctggacatcaccaagacgagggacatcagtattcccttggtcagtctggatttttcgggtgagtctttctggtatccaaaatgggttgtcttcattctgtgggaaaacacaaaccgctcccctggatcttatcaaaataggatccgggccataccatttattatcaaggacatttttccatttaaccatctcattgggcctatctggctctgaacaatgacgttcagccgcagtatggccatgaacatcaatatttaaaaaattgagtgtaaagagtgccatagacacagacactcttggtactcggggtagagtctcctcaattcccctcttctgttttataagataggctttgagggtgcgatgcgcacgctcaacaataccctgtccttgagggttgtatggaagtccagtcaggtgggtcacgtccatctgacggcagaactgctggaatttttgagatgtataagctggtccattatcagtcttaaggagtttgggtttcccccaagcactccatgcctcaagacaatgttgaatcacatgtgaggctttttctccggttaacggagaagcaaacatgatgccagaacatgtgtcaatggacacatggagatattgaagttttccaaaggaagaaacatgtgtaacatccatttgccagacctgtagaggtcgaataccgcgtgggttaattcccacatgaggaactggcaagatctcacagcagctttgacattgagtaacaatgtcacgggcttcttttcttgtcaaggagaaacgactgcgtaatgtttcagctgtcacatgaaaattgttatgaaaatttcttgcagcctctaccggggatgatagggcagcagccaccactttagtggccttatctgccaaatcatttcccagagccatggggccaggtaggcctgaatgggctctaacatgagtaatataaacaggaaatcttctagataacaaaactaattgtatctgctgaaaaatattggcaactctactggaaggcttaatcactccagccacttctaaaagatttactgcattaaccacataacaggaatctgatacaatattaaggggttctaaaaaggtttttaaaacttctaaaaccactaaacattctaccacttgaggtgaatttacattatattgtttggataccactttaccattagccacataggcacctatgccagtttttgatccatcagtatataccacaatcccatttttaagtgggtttcttactgttatttgtggaaacacaacagattgattttgggcaaactgtaaaattggatgttttggataatggttatctatttgtcctgaaaaggaggtaactaaaactgcccaatcattagatgtggctgtcaaggtttgaacctgtgcagcggtataaggtacaattaaaagatatggacttcgcccaaagtgggtgattgctgcttttaggcctttaagggcaagctgtgcaattgcatcaggataccaatctattattttagctggggatacgtttggatggatccacaacaatggcccattctgccacaaaactgcggttggcaattgtgctgtcttaaagacacacaaactgaaaggctgcgaatcctcaatacgttgtaattgtgcattctgtaaggctttttccaccttttgtaaggccgggttagcagctagagtaagagccctaggggaggagatatgaggatctccttctaaaataccaaacaaaggccttaactcagcggaaggaatctttaaaaaaggtctgagccaattaatatctcccaacagcttttgaaaatcatttaaggtatggaggtgatctcttcttatctctaccttttggggcacaatcttatctggggacaccacagagcccaagaattgtcctgtatcagaaatttggactttttctgtggctatctgtaaaccccactgacttaaagttttaagtagaaaaggatatgccttttgtagcatggtaaggtttttatggcacaggaggatgtcatccatgtaaaggagcaaaattaaagaggggaattgttccctcactggcaaaagagcttcttgcacataaagttggcacatagtaggactattggacattccctgtggtaagaccttccattgatacctcttatcaggttccatgtgattaatagaggggatggtaaaggcaaatctgggcctatcccttggacacaaaggtatagaaaagaaacaatctttaatatctataataattaaattccagccacgtggtaaggcggaatgtacagggagacccctctgtactgggccaaataagttcatttgctcattaatggctctgaggtcatggagcagtctccactttcctgactttttcttaattacaaaaattggagtattccaaggtgaggtagagggttcaatatggcctagttttaattgttcctctaccagttgaatcacagcttccagtttttcagaggataggggccattgaggaacccacactggatcccctgttttccatggtatgggccgtgctgccccaatggccactaaggaaaacccagaccctgtctgtcttggtttccattaggtgagatgggctctatccttccctgttcttgatgtcctaacccttttccttctttataacccatctttgccatgatattttttgctttagctgaatatcctcccgatggggcgttttcattggacaaaataaggcccaaatgctgcataatatcccttccccagaggttaaccgggagtgggagcacataaggtatgaatttcccttgctgcccttcagaggattcccacgtcaaggcaatggaacttatagtgggacatgattgataacctaggccctgtaatgaatgagatgactctgtggtgggccatgctttgggccaccaatgtgtagaaattatacttttatctgctccggtatcaaggatgccttcaaactcttttccgttgatcttaaggcggagcttaggtctatcattcaaagatacaaccaaataggcagaatcatttcctgaggagcccattttctttatctcaggtcctgcaaatttctccctggtattatcagggaggagcagcagctgagctatcctatctcctttactaatagaaaaaacgcccttagggcttgagcacaggacctgtatttcaggggaatgttgacaatccataactccagggtggactactaagccctgcaaggtgagtgaaccccggccaagaataaggcccatggttcccgggggcaaggatggtataggctccactggcaccggctgaatactcatttgaggcattaataggaagtcggaggcggcacgcaggtccacccttgtgggtcttcctgggtcgcctctctgactgcttcctgggtcctgacaaaccggttcccatatctttgagggccctgggaccgagggcccgatgacccgtttttttggcacataagctgattgactatcaggtgggggaaggattctgccctttatatccctcacagagcgacactggtcggctctatgataacccttgccacacttagagcaaagagtgagagtccctccctgtttatctggagctctgcaatctttcttaagatgcccaggctttccacagttaaaacatgtcctctgatcatttcttcccatggagcggttttgggattaaaggatggcagccgctaaacctgcattgctgagaggtcccccaagctctcgacaaactctgagccagtcttgtaagcctttgttctttcttggggctatggccgctcggcactcctttgtggcttgctcatagatgagctgttctaccagaggtgcggcttgctctgagtctccaaaaatatgctctgctgcctctgtcattctggccacaaaatctgagaaggactcctgaggtccctggacgatctttgttaattgcccagtggcttcacctgctcgggagagcgccttccaggccctaatagccgtggaggaaatttgggcataagctccccaatggtagtttgtctgatcagcagaataagctccctgacccgttaacaagtcaaaagtccaatctctctgctctgtagtcaaagcagctgcgtttgttcgggcctgtgcttgtgcagcctcatgccaaagcgctctccattccatatatttgcccatactagggagagcggcttttacaatcgtttgccagtcagcaggagttagtgccatgccggcaagcctgtctaactgcaccaaggtaaaattagcattggttctgtatttacggaccgactcggcaagttctttaatctgcacgtattctaccggagcgtggacacgcccaccctcggctccttcaaagaccggaaatgcctgttgtattttcctttgttcctctctgggaatgaatgagtctgcgcattgcctctctgcgcattgtctctctgcgcattgtctctctgcgcagggctgacgcactacgcagggcgggggctccgcatagggcggaccttgaagccgactgcccgcaggctgaacagcatgctggctttcgccagccgcttttggcttttttcttgaccaactagctagcactttatctggctggtaatgagctgcttcttcctcccagtctgtttcttcagaggagaattcttcatctgcttcagagctactaagagctggcttcctgagctcatctagtgacgagtatctcctagagacctccgctaattaatcttttttcttttcttttttcttttccttccttctaatctctccccaggtattcttacctgacctaaacttttccttgggttcaagacccttggaaaggcctgtatacttattctgtgcaccatatttcctctttgctcctactctctctccccgctttacttctgatagattgtcctgaatttcatctagaattttcagccctatcttaatcacttgataacatgtgaaaaagaacaaaagggctcctaacactagaaaaagttcaaggccaaacataccttgtaaagctattttccactttacttctgatagactgtcttgaatttcgttagaaagttcaagaccagacttaccttgtaaagctgtactcactggtactcctgttccccagctgaaaagttctgaattcatgcagttgaatccttctcaacagtctgttttacgggaacctttattaccgtgacccgcagttctggttccggaatgagggatcttccttgcgccggtgatggttaactcccgtcccgagttttcttgtattttctcgtcccgggtttttttcttcccggattttctcgtcccgggtttcggcaccaactcttaaacgcgttctcacgaccagccaggaagaacacaacaaaccagaatcttctgcggcaaaactttattgcttacatcttcaggagccaggagcgcaagccccaagccccaaaaacgaaaggcccacgcttacatctttaggagccagagcgccagcgcgccagagcaaaagcgcaagagcgcaagtaagagagagaatggcggaaaccccatccccttttaaggagaattatccttcgcctaggacgcatcactccctgattggctgcagcccatggccgagtaaaggcagagtacatgtagtggaaaattactcttggcacatgcgcagattatttgtttaccacttaagaacacaggatgtcagcgccatcttgtgacggcgaatgtgggggcggctcccaacaataacacattgacacaaatggatacatgtatagatatgggttctgtggccttggtccaggattctcaggagattttcaggaatcacctttcacgttgagtcgggtcatacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatacctacaaaatggtgaggctaaggtcacctgtgatgtggctgttgcttcgagaggaagcagtaaatctttattggaatgccagggttcctttgtgtgtccactgatgtttctctatggtagccaggaagacttgtgtgtgctgggctggtaatacaagaggtaaccccaggacagtttctgcacaatgaagttgtacaagtagagctccagaaaaatgtctctctcctctgacctttatttaaagaagggacaacaagcgtcttgacttctttccctttcctccttagggaagacattcttccaagtatcaagaaagggagcccttgcttccctggaagacatttcgtcccagcaatccctctccagttccatataaccattcctactctgagccagttttggaaaagaaggtaagtggttggattaggttaggtgatatccaagtagatgtagccgaattctgtctaggactgggtcaatgatgacaacccaatgtcatgaagaaaggtgatgacataaaattcatgctcaataggattacgctgaggcccaaccagggcgacagggtcacaagaggtccgttgactccttggggggccctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatctccccttgctcatgacaatgtcttttctggtgttttgcagtcatctcatatgccaccttggaaggcagagaaacacagataatcaggtaagtggtcagaacatggtaaagcctccacatccaggtgacctcccccttcatgatttggctttcaattctcagcatgtcagtccttttggaattagggataacaaaatggtatacaatggtaccaaaggagctcgatttaggctatgttccccgatgtacatcccctggtttgtaacgttttaaggaatgtgttcaactcccgataattgttttttcataattttgacctacttctcatggagagaggagaatgacattttttgaatgttgggatctcatactttgatgcttacaattttatggaaaatagctacaggaggacaacactggcctccagggccttatggtactcttcctttcccttgacaggggaggcccaagtgacagatcctttcttagggaaaaagaaggattctatgatatccaaaaaggctgtcctccccaggatgggttcacaaagggcaatccctctagcagatattccaaagatctcaccccagagacaatttaccaatttggatagggtgagatattcatttttaccttggtacccaccacattccaaatttccttcatggtatcatttagggcacttactgaacctcactgcagaatcactgaggaaaaaaagctctacatattaggttgatacagggtaaggccaggtgtttaaagaacctaattccactttgattcataacaccaaggcctgactttagtccagcaacagtgcttacactcacattttacagcagggcaacccataacacgttgacacaaatggatacatgtatagacatgggttctgtggccttggtccaggattctcgggagattttcaggaatcacctttcacgttgagtcgggtcgtacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatacctacaaaatggtgaggctaaggtcacctgtgttgtggctgttgcttcgagaggaagcagtaaatctttattggaatgccagggttcctttgtgtgtccactgatgtttctctatggtagccaggaagacttgtgtgtgctgggctggtagtaatacaagatgtaaccccaggacagtttctgcacaatgaagttgtaccagtagagctccagaaacatgtctctctcctctgacctttatttaaagaagggacaacaagcgtctttacttctttccctttcctccttagggaagacattctttcaagtatcaagaaagggagcccttgcttccctggaagacatttcgtcccaacaatccctctcaaattccatatgaccattcctactctgagccagttttggaaaggaaggtaagtggttggattaggttaggtgatatccaagtagaggtagccgaattctgtctaggactgggtcaatggtgacaacccaatgtcatgaagaaaggtgatgacataaaattcatgctcaataggattacgctgaggcccaaccagggcgacagggtcacaactggtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcatatgccaccttggaaggcagagaaacacagataatcaggtaagtggtcagaacatggtaaagcctccacatccaggtgacctcccccttcatgatttggctttcaattctcagccagttggtccttttggaattagggataactaaatggtatacaacggtaccaaaggagctcgatttaggctatgatctcagatgtacaacccctggattgtaacgttttaaggaatgtgttcaactcccaataattgttttttcataattttgacctacttctcatggagagaggaggatgacattttttgaatgttgggatctcatactttgatgcttacaattttatggcaaatagctacaggaggacaacactggcctccagggccttatggtactcttcctttcccttgacaggggaggcccaagtgacagatcctttcttaggtaaaaagaaggattctatgatatccaaaaaggctgtcctccccaggatgggttcacaaagggcaatccctctagcagtgattccaaagatctcaccccagagtcaatttaccaatttggatagggtgagatattcatttttaccttggtgcccaccacattccaaatttccttcatggtatcatttagggcacttactgaacctcactgcagaatcactgaggaaaaaaagctctacacattaggttgatacagggtaaggccaggtgtttaaagaacctaattccactttgattcataacaccaaggcctgactttagtccagcaacagtgcttaaactcacgttttacagaagggcaacccataacacgttgacaaaaatggatacatgtatagacatgggttctgtggcctcggtacaggattctcaggagattttcaggaatcacctttcacggtgagtcgggtcgtacaacatagactttacagaggtctgatgccacatttgctctttgagcaaaaacacacagttactttaatcaccctcgaaatacctatctgtagttgttttattcaattatttttttgtcctatccatagaacttgggcagctcaacttgagtgttgatacctacaaaatggtgaggctaaggtcacctttgatgtggctgttgcttcgagaggaagcagtaaatctttattggaatgccagggttcctttgtgtgtccactgatgtttctctatggtagccaggaagacttgtgtgtgctgggctggtaatacaagaggtaaccccaggacagtttctacacaatgaagttgtacaagtagagctccagaaaaatgtctctctcctctgacctttatttaaagaagggacaacaagcgtctttacttctttccctttcctcgttagggaagacattcttccaagtatcaagaaagggagcccttgcttccctggaagacatttcctcccagcaatccctctccagttccatatgaccattcctactctgagccagttttggaaaggaaggtaagtggttggattaggttaggtgatatccaagtagaggtagccgaattctgtctaggactgggtcaatgatgacaacccaatgtcatgaagaaaggtgatgacataaaattcatgctcaataggattacgctgaggcccaaccagggcgacagggtcacaagaggtccgttgactccttgggggctctagggtgacttccctgaagtcctcagatgcccttgccctgtttcccatgagaggaaatatggacatctagggtgcacattggttggcaaacactgcatgccaacaagcacctagtcccacaatggaaccttgggcatttctgcaaggatcgccccttgctcatgacaatgtcttttctggtgttttgcagtcatctcatatgccaccttggaaggcagagaaacacagataatcaggtaagtggtcagaacatggtaaagcctccacatccaggtgacctcccccttcatgatttggctttcaattctcagccagttggtccttttggaattagggataacaaaatggtatacaacggtaccaaaggagctcgatttaggctatgttctccgaagtacaacccctggattgtaacgttttaaggaatgtgttcaactcccgataattgttttttcataattttgaccttcttctcatggagagaggaggatgacattttttgaatgttgggatctcatactttgatgcttacaattttatggcaaatagctacaggaggacaacactggcctccagggccttatggtactcttcctttcccttgacaggggaggcccaagtgacagatcctttcttaggtaaaaagaaggattctatgatatccaaaaaggctgtcctccccaggatgggttcacaaagggcaatccctctagcagtgattccaaagatctcaccccagagtcaatttaccaatttggatagggtgagatattcatttttaccttggtacccaccacattccaaatttccttcatggtatcatttagggcacttactgaacctcactgcagaatcactgaggaaaaaaagctctacacattaggttgatacagggtaaggccaggtgtttaaagaacctaattccactttgattcataacaccaaggcctgactttagtccagcaacagtgcttaaactcacgttttacagaagggcaacccataacacgttgacaaaaatggatacatgtatagacatgggttctgtggcctcggtacaggattctcaggagattttcaggaatcacctttcacggtgagtcgggtcgtacaacatagactttacagaggtctgatgccacatttgctctttgagcaaaaacacacagttactttaatcaccctcgaaatacctatctgtagttgttttattcaattatttttttgtcctatccatagaacttgggcagctcaacttgagtgttgatacctacaaaatggtgaggctaaggtcacctttgatgtggctgttgcttcgagaggaagcagtaaatctttattggaatgccagggttcctttgtgtgtccactgatgtttctctatggtagccaggaagacttgtgtgtgctgggctggtaatacaagaggtaaccccaggacagtttctgcacaatgaagttgtacaagtagagctccagaaaaatgtctctctcctctgacctttatttaaagaagggacaacaagcgtctttacttctttccctttcctcgttagggaagacattcttccaagtatcaagaaagggagcccttgcttccctggaagacatttcctcccagcaatccctctccagttccatatgaccattcctactctgagccagttttggaaaggaaggtaagtggttggattaggttaggtgatatccaagtagaggtagccgaattctgtctaggactgggtcaatgatgacaacccaatgtcatgaagaaaggtgatgacataaaattcatgctcaataggattacgctgaggcccaaccagggcgacagggtcacaagaggtccgttgactccttgggggctctagggtgacttccctgaagtcctcagatgcccttgccctgtttcccatgagaggaaatatggacatctagggtgcacattggttggcaaacactgcatgccaacaagcacctagtcccacaatggaaccttgggcatttctgcaaggatcgccccttgctcatgacaatgtcttttctggtgttttgcagtcatctcatatgccaccttggaaggcagagaaacacagataatcaggtaagtggtcagaacatggtaaagcctccacatccaggtgacctcccccttcatgatttggctttcaattctcagccagtcggtccttttggaattagggataacaaaatggtatacaatggtaccaaaggagctcgatttaggctatgttccccgatgtacatcctctggtttgtaacgttttaaggaatgtgttcaactcccgataatcgttttttcataattttgacctacttctcatggagagaggagaatgacattttttgaatgttgggatctcatactttgatgcttacaattttatggcaaatagctacagggggacaacactggcctccagggccttatggtactcttcctttcccttgacaggggaggcccaagtgacagatcctttcttagggaaaaagaaggattctatgatatccaaaaaggctgtcctccacaggatgggttcacaaagggcaatccctctagcagatattccaaagatctcaccccagagacaatttaccaatttggatagggtgagatattcatttttaccttggtacccaccacattccaaatttccttcatggtatcatttagggcacttactgaacctcactgcagaatcactgaggaaaaaaagctctacatattaggttgatacagggtaaggccaggtgtttaaagaacctaattccactttgattcataacaccaaggcctgactttagtccagcaacagtgcttaaactcacgttttacagcagggcaacccataacacgttgacacaaatggatacatgtatagacatgggttctgtggccttggtccaggattctcgggagattttcaggaatcacctttcacgttgagtcgggtcgtacaacatagaccttacagaggtctgatgccacatttgcactttgagcaaaatcacacagttactttaatcaccctcgaaatacctatatgtagttgttttattcaattatttttttgtcctatccatagaacttgggcagctcaacttgagtgttgatacctacagaatggtgaggctaaggtcacctatgttgtggctgttgcttcgaaaggaagcagtaaatctttattggaatgccagggttcctttgtgtgtccactgatgtttctctatggtagccaggaagacttgtgtgtgctgggctggtagtaatacaagaggtaaccccaggacagtttctgcacaatgaagttgtaccagtagagctccagaaacatgtctctctcctctgacctttatttaaacaagggacaacaagcgtcttgacttctttccctttcctccttagggaagacattcttccaagtatcaagaaagggagcccttgcttccctggaagacatttcgtcccagcaatccctctccagttccatgtgaccattcctactctgagccagttttggaaaggaaggtaagtggttggattaggttaggtgatatccaagtagaggtagccgaattctgtctaggactgggtcaatgatgacaacccaatgtcatgaacaaaggtgatgacataaaattcatgctcaataggattacgctgaggcccaaccagggcaacagggtcacaagaggtccgttgactccttggggggctctagggtgacttccctgaagtactcagatgcccttgccctgtttcccatgagaggaaatgtggacatctagggtgcacattggttggcaaacactgcatgccaacaagcacctagtcccacaatggaaccttgggcatttctgcaaggatcgccccttgctcatgaaaatgtcttttctggtgttttgcagtcatctcacatgccaccttggaaggcagagcaacacagataatcaggtaagtggtcagaacatggtaaagcctccacatccatgtgacctcccccttcatgatttggctttcaattctcagccagtcggtccttttggaatttggggataacaaaatggtatgcaaaggtaccaaaggagctctatttaggctatgttctccgatgtacatcccctgatttgtaaccttttttaggaatgtgtttaactcccgataattgttttttcataattttgacctacttctcattgagagaggagcatgacattttttgaatcttaggatctcatactttgatgcttacaattttatggtaaatagctacaggaggacaatacaggcctccagggccttatgggactcttcctttttcttgacaggggaggcccatgtgacagagcctttcttagggaaaaagaaggattttatgatatccaaaaaggctgtcctccccaggatgggttcacaaagggcaatccctctagcagataatccaaagttctcaccccagagaaaatttaccattgtggaaagggtgagatattcatttttaacttggtgcccaccacattccaaatttccttcatggtatcatttagggcacttactgaacctcactgcagaatcactgaggaaataaagctctacacattaggttgatacagggtaaggccaggtgtttaaagaacctaattgcactttgattcataacaccaaggcctgacttgagtccagcaacagtggttatcctcacgttttacagcagggcaacccataacaccttgacacaaatggatccatgtatagacatgggttctgtggcctggtcccaggattctcgcgagattttcagtaatcacctttcacgttgagtcgggtcttacaacatagaccttacagaggtctgatgccacatttgcactttgagcaaaaacacacagttactttaatcaccctcgaaatacctatctgtagttgttttattcaattatttttttgtcttatccatagaacttgggcagctcaacttgagtgttgatacctacaaaatggtgaggctaaggtcacctgtgatgtggctgttgcttcgagaggaagcagtaaatcatattggaatgccagggttcctttgtgtgttcactgatgtttctctatggtacccaggaagacttgtgtgtgctgggctggtagtaatacaagaggtaaccccaggacagtttctgcacaatgaagttgtaccagtagagctccagaaacatgtctctctcctctgacctttatttaaagaagggacaacaagcgtcttgacttctttccctttcctcctttgggaagacattcttccaagtatcaagaaagggagcccttgcttccctggaagacatttcgtcccagcaatccctctccagttccatgtgaccattcctactctgagccagttttggaaagaaggtaagtggttggattaggttaggtgatatccaagtagaggtagccgaattctgtctaggactgggtcaatgatgacaacccaatgtcatgaagaacggtgatgacataaaattcatgctcaataggattacgctgaggcccaaccagggcgacagggtcacaagaggtccgttgactccttggggggctctagggtgacttccctgtagtcctcagatgcccttgccctgtttcccatgagaggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagcaacacagataatcaggtaagtggtcagaacatggtaaagcctccacatccaggtgacctcccccttcatgatttggctttcaattctcagccagtcggtccttttggaatttggggataacaaaatggtatgcaaaggtaccaaaggagctctatttaggctatgttctccgatgtacatcccctgatttgtaaccttttttaggaatgtgtttaactcccgataattgttttttcataattttgacctacttctcattgagagaggagcatgacattttttgaatcttaggatctcatactttgatgcttacaattttatggcaaatagctacaggaggacaacacaggcctccagggccttatgggactcttcctttcccttgacagtggaggcccaagtgacagagcctttcttagggaaaaagaaggattttatgatatccaaaaatgctgtcctccccaggatgggttcacaaagggcaatccctctagcagatattccaaagatctcaccccagagacaatttaccattgtggaaagggtgagatattcatttttaacttggtgcccaccacattccaaatttccttcatggtatcatttaggacacttactgaacctcactgcagaatcactgaggaaataaagctctacacattaggttgatacagggtaaggccaggtgtttaaagaagctaattgcactttgattcataacaccaaggcctgacttgagtccagcaacagtggttatcctcacgttttacagcagggcaacccataacaccttgacacaaatggatccatgtatagacatgggttctgtggcctgggcccaggattctcgcgagattttcagtaatcacctttcatgttgagtcgggtcttacaacatagaccttacaaaggtctgatgccacatttgcactttgagcaaaaacacacagttatttaatcaccctcgaaatacctatctgtagttgttttattcaattatttttttgtcttatccatagaacttgggcagctcaacttgagtgttgatacctacaaaatggtgaggctaaggtcacctgtgatgtggctgttgcttcgagaggaagcagtaaatcttattggaatgccagggttcctttgtgtgttcactgatgattctctatggtagccaggaagacttgtgtatgctgggctggtagtaatacaagaggtaaccccaggacagtttctgcacaatgaagttgtacaagtagagctccagaaaaatgtgtctctcctctgacctttatttaaagaagggacaacaagcgccttgacttctttccctttcctccttagggaagacattcttccaagtatcaaaaagggagcccttgcttccctggaagacatttcgtcccagcaatcccgctccagttccatgtgaccattcctaatctgagccagttttgaaaaggaaggtaagtggttggattatattaggtgatatccaagtagaggtagccgaattctgtctaggactgggtcaatgataacaacccaatgtcatgaagaaaggtgatgacataaaattcatgctcaataggattacgctgaggcccaaccagggcgacaggatcacaagagggtctgttgactccttggggagctctagggtgacttccctgaagtcctcagatgcccttgccctgttccccatgagaggaaatgtggacatctagggtgcacattggttggcaaacactgcatgccaacaagcacctagtcccacaatggaaccttgggcatttctgcaaggatctccccttgctcatgacaatgtcttttctggtgttttgcagtcatctcatatgccaccttggaaggcagagaaacacagataatcaggtaagtggtcagaacatggtaaagcctccacatccaggtgacctcccccttcatgatttggctttcaattctcagcatgtcagtccttttggaattagggataacaaaatggtatacaaaggtaccaaaggagctcaatttagactatgttctccgacgtacatcccctggtttgtaacgttttaaagaatgtgttcaactcccgataattgttttttcataattttgacctacttctcatggagagaggaggatgacattttttgaatgttgggatctcatacattgatgcttacaattttatggcaaatagctccaggaggacaacactggcctccagggccttatggtacacttcctttcccttgagaggggaggcccaagtgacagatcctttcttaggtaaaaagaaggattctatgatatccaaaaaggctgtcctccccaggatgggttcacaaagggcaatccctctagcagatattccaaagatctcaccccagagacaatttactcatatggattgggtgagatattcatttttgccttgctgcccaccacattccaaatttccttcattttatcatttaggacacttactgaacctcactgcagaatcactgaggaaaaaaaggtctagacattaggttgatacagggtaaggcaacgtgtttaaagaacctaattccactttgattcataacaccaaggcctgatttgagtccagcaacagtgcttacactcacgttttacagcagggcaacccaaatcaccttgacacaaataaatccatgtatagacatgggttctgtggcctgggcccaggattctcgggagattttcaggaatcacctttcacgttgagtctggtctttcaacatagaacttacagaggtctgatgccacatttgcactttgagcaaaaacacagttactttaatcaccctcaaaatacctatctgtagttgttttattcaattattttttgtcttatccatagaacttgggcagctcaacttgagtgttgatacctacaaaatggtgaggctaaggtcacctgtgatgtggctgttgcttcgagaggaagcagtaaatctttattggaatgccagggttcctttgtgtgtccactgatgtttctctatggtagccaggaagacttgtgtatgctgggctggtagtaatacaagaggtaaccccaggacagtttctgcacaatgaagttgtaccagtagagctccagaaaaatgtctctctcctctgacctttatttaaagaagggacaacaagcgtcttgacttctttccctttcctccttagggaagacattcttccaagtatcaagaaagggagcccttgcttccctggaagacatttcgtcccagcaatcccgctccagttccatgtgaccattcctactctgagccagttttggaaaggaaggtaagtggttggattatgttaggtgatatccaagtagaggtagccgaattctgtctaggactgggtcaatgatgacaacccaatgtcatgaagaacggtgatgacataaaattcatgctcaataggattacgctgaggcccaaccagtgcgacagggtcacaagaggtccgttgactccttggggggctctagggtgacttccctgtagtcctcagatgcccttgccctgtttcccatgagaggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagcaacacaaataatcaggtaagtggtcagaacatggtaaagcctccacatccaggtgacctcccccttcatgatttggctttcaattctcagccagtcggtccttttggaatttggggataacaaaatggtatgcaaaggtaccaaaggagctctatttaggctatgttctccgatgtacatcccctgatttgtaaccttttttaggaatgtgtttaactcccgataattgttttttcataattttgacctacttctcattgagagaggagcatgacattttttgaatcttaggatctcatactttgatgcttacaatttcatggcaaatagctacaggaggacaacacaggcctccagggccttatgggactcttcctttcccttgacaggggaggcccaagtgacagaccctttcttagggaaaaagaaggattctctgatatacaaaaaggctgtcctcccaaggatgggttcacaaagggcaatccctctagcagatattccaaagatctcaccccagagacaatttaccaatgtggatagggtgagatattcatttttaccttggtacccaccacattccaaatttccttcatggtatcatttagggcacttactgaacctcactgcagaattactgaggaaaaaaatctctacacattaggttgatacagggtaaggccaggtgtttaaagaacctaattccactttgattcataacaccaaggcctgactttagtccagcaacagtgcttacactcacgttttacagcagggcaacccataacacgttgacacaaatggatacatgtatagacatgggttctgtggcctcggtccaggattctcgggagattttcaggaatcacctttcacgttgagtccggtcgtacaacatagaccttacagaggtctgatgccacatttgcacgttgagcaaaaacacacagttactttaatcaccctcgaaatacctatctgtagttgttttattcaattacttttttgtcctatccatataacttgggtagctcaacttgagtgttgatacctacaaaatggtgaggttaaggtcacctgtgatgtggctgttgcttcgagaggaagcagtaaatctttattggaatgccagggttcctttgtgtgtccactgatgtttctctatggtagccaggaagacttgtgtgtgctgggctggtagtaatacatgaggtaaccccaggacagtttctgaacaatgaagttgtacaagtagagctccagaaaaatgtctctctcctctgacctttattgaaagaagggacaacaagcgtcttgacatctttccctttcctccttagggaagacattcttccaagtatcaagaaagggagcccttgcttccctggaagacatttcgtaagagcaatttctccccagttctgtgtgaccattcctactctgagccagttttggaaaggaaggtaagtggttggattaggttaggtgatatccaagtagaggtagccgaattctgtctaggactaggtcaatgatgacaacccaatgtcatgaagaaaggtgatgacataaaattcatgctcaataggtttatgctgaggcccaaccagtgcgacagggtcacaagaggtccgttgactttttggggggctctagggtgacttccctgaagtcctcagatgcccttgccctgtttcccatgagaggaaatgtggacatctagggtgcacagtggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaattagggataacaaaatggtatacaacggtaccaaaggagctcgatttaggctatgttctccgatgtacatcccctggtttgtaacgttttaaggaatgtgttcaactcccgataattgttttttcataattttgacctacttctcatggagagaggagaatgacattttttgaatgttgggatctcatactttgatgcttacaattttatggcaaatagctacaggaggacaacactggcctccaggaccttatgggactcttcctttcccttgagaggggaggcccaagtgacagatcctttcttagggaaaaagaaggattctatgatattcaaaaaggctgtcctccccaggatgggtttacaaagggcaatccctctagcagatattccaaagatctcacccctgagacaatttaccaatgtggatagggtgagatattcatttttaccttggtacccaccacattccaaatttccttcatggtatcatttagggcacttactgaacctcactgcagaatcactgaggtaaaaaagctctacacattaggttgatacagggtaatgccaggtgtttaaagaacctaattgcactttgattcataacaccaaggcctgacttgagtccagcaacagtggataccctcacgttttacagcagggcaacccatagcaccttgacacaaatggataaatgtgtagacatgggttctgtggcctgggcccaggattctcgggagattttcaggaatcacctttcacgttgagttgggtcttacaacatagaccttacagagctctgatgccacatttgcactttgagcaaaaacacacagttactttaatcacccttgaaatacctatctgtagttgttttattcaattattttttttgtcctatccatagaacttgggcagctcaacttgagtgttgatacctacaaaatggtgaggctaaggtcacctgtgatgtggctgttgcttcgagaggaagcagtaaatctttattggaatgccatagttcctttgtgtgtccactgatgtttctgtatggtagccaggaagacttgtttgtgctgggctggtagtaataaatgaggtacccccaggacaatttctgcacaatgaagttgtaccaatagagctccagaaaaatgtctctctcctcagacctttatttaaagatgggacaacaagcgtcttgacttctttccctttcctccttaggaaagacattcttccaagttgcttccctggaagatatttcgtcccagcaatccctctccagttccatgtgaccattcctactctgagccagttttggaaaggaaggtaagtggttggattaggttaggtgatatccaagtagaggtagccgaattccgtctaggactgggttaatgatgacaacccaatgtcatgaagaaaggtgatgacataaaattcatgctcaataggattacgctgaggcccaaccagggcgacagggtcacaagaggtccgttgactctttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggattgccccttgctcatggcaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaattagggataaaaaatggtatacaaccgtacaaaaggagctcgatttaggctatgttctccgatgtacatcccctggtttgtaacgttttaaggaatgtgttcaactccctataattgttttttcataattttgacctacttctcatggagagaggaggatgacattttttgaatgttgggatctcataccttgatgcttacaattccatggcaaatagcttcaggaggacaacacagggctccagggcctcatgggagtcttcctttcccttgacaggggaggcccaagtgacagaccctttcttagggaaaaagaaggattctatgatatccaaaaaggctgtcctccccaggatgggttcacaaagggcaatccctctagcagatattccaaagatctcaccccagagacaatttaccaatgtggatagggtgagatattcatttttaccttggtacccaccacattccaaatttccttcatggtatcatttagggcacttactgaacctcactgcagaatcactgaggaaaaaaagctctacacattaggttgatacagggtaaggccaggtgtttaaagaacctaattccactttgattcataacaccaaggcctgactttagtccagcaacagtgcttacactcacgttttacagcagggcaacccataacacgttgacacaaatggatacatgtatagacatgggttctgtggcctcggtccaggattctcaggagattatcaggaatcaactttttatgttgagtcgggtcttacaacatagaccttacagaggtctgatgccacatttgcactttgagcaaaaacacacagttattttaatcaccctcgaaatacctatctgtagttgttttattcaattatttttttgtcctatccatagaacttgggcagctcaacttgagtgttgatacctacaaaattgtgaggctaaggtcacctgtgatgtggctgttgcttcgagaggaagcagtaaatctttattggaatgccaggattcctttgtgtgtccactgatgtttctctatggtagccaggaagacttgtgtgtgctgggctggtagtaatacaagaggtaacccgaggacagtttctgaacaatgaagttgtacaagtagagctccagaaaaatgtctctctcctctgacctttatttaaagaagggacaacaagcgtcttgacttctttccctttcctccttagggaagacattcttccaagtatcaagaaagggagcccttgcttccctggaagacatttcgtcccagcaatccctctccagttccatatgaccattcctactctgagccagttttggaaaggaaggtaagtggttggattaggttagttgatatccaagtagatgtagccgaattctgtctaggactgggtcagtgatgacaacccaatgtcatgaagaaaggtgttgacataaaattcatgctcaataggattacgctgaggcccaaccagggcgacagggtcagaagaggtccgttgactccatggggggctctagggtgacttccctgaagtcctcagatgcccttgccctgtttcccatgagaggaaatgtggacatctagggtgcacattggttggcaaacattgcatgccaacaagcacctagtcccacaatggaaccttgggcatttctgcaaggatcgccccttgctcatgacaatgtcttttctggtgttttgcagtcatctcatatgccaccttggaaggcagagaaacacaggtaatcaggtaagtggtcagaacatggtaaagcctccacatccaggtgacctcccccttcatgatttggctttcaattctcagcatgtcagtccttttggaattagggataacaaaatggtatacaatggtaccaaaggagctcgatttaggctatgttccccaatgtacatcccctggtttgtaacgttttaaggaatgtgttcaactcccgataattgtgttttcataattttgacctacttctcatggagagaggagaatgacattttttgaatgttgggatctcatactttgatgcttacaattttatggcaaatagctacaggaggacaacactggcctccaggaccttatgggactcttcctttcccttgagaggggaggcccaagtgacagatcctttcttagggaaaaagaaggattctatgatattcaaaaaggctgtcctccccaggatgggtttacaaagggcaatccctctagcagatattccaaagatctcacccctgagacaatttaccaatgtggatagggtgagatattcatttttaccttggtacccaccacattccaaatttccttcatggtatcatttagggcacttactgaacctcactgcagaatcactgaggtaaaaaagctctacacattaggttgatacagggtaatgccaggtgtttaaagaacctaattgcactttgattcataacaccaaggcctgacttgagtccagcaacagtggataccctcacgttttacagcagggcaacccatagcaccttgacacaaatggataaatgtgtagacatgggttctgtggcctgggcccaggattctcgggagattttcaggaatcacctttcacgttgagttgggtcttacaacatagaccttacagaggtctgatgccacatttgcactttgagcaaaaacacacagttactttaatcacccttgaaatacctatctgtagttgttttattcaattatttttttgtcctatccatagaacttgggcagctcaacttgagtgttgatacctacaaaatggtgaggctaaggtcacctgtgatgtggctgttgcttcgagaggaagcagtaaatctttattggaatgccagggttcctttgtgtgtccactgatgtttctgtatggtagccaggaagacttgtttgtgctgggctggtagtaataaatgaggtacccccaggacaatttctgcacaatgaagttgtaccaatagagctccagaaaaatgtctcactcctcagacctttatttaaagatgggacaacaagcgtcttgacttctttccctttcctccttaggaaagacattcttccaagttgcttccctggaagatatttcgtcccagcaatccctctccagttccatgtgaccattcctactctgagccagttttggaaaggaaggtaagtggttggattaggttaggtgatatccaagtagaggtagccgaattccgtctaggactgggttaatgatgacaacccaatgtcatgaagaaaggtgatgacataaaattcatgctcaataggattacgctgaggcccaaccagggcgacagggtcacaagaggtccgttgactccttgaggggctctagggtgacttccctgaagtcctcagatgccctttccctgtttcccatgagaggaaatgtggacatctagggtgcacattggttggcaaacactgcatgccaacaagcacctattcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccaatcggtccttttggaattagggataacaaaatggtatacaacggtaccaaaggagctcgatttaggctatgttctccgatgtacatcccctggtttgtaacgttttaaggaatgtgttcaactcccgataattgttctttcataattttgacctacttctcatggagagaggagggtgacattttttgaatgttgggttctcatactttgatgcttacaattccatggcaaatagcttcaggaggacaacacaggcctccagggcctaatgggagtcttcctttcccttgacaggagaggcccaagtgacagaccctttcttagggaaaaagaaggattctatgatatcaaaaaaggctgtcctccccaggatgggttcacaaagggcaatccctctagcagacattccaaagatctcaccccagagacaatttaccaatgtggatagggtgagatattcatttttaccttggtacccaccacattccaaatttccttcatggtatcatttagggcacttactgaacctcactgcagaatcactgaggaaaaaaagctctacacattaggttgatacagggtaaggccaggtgtttaaagaacctaattccactttgattcataacaccaaggcctgactttagtccagcaacagtgcttacactcacgttttacagcagggcaacccataacacgttgacacaaatggatacatgtatagacatgggttctgtggcctccgtccaggattctcgggagattttcaggaatcacctttcacgttgagtcgggtcttacaacatagaccttacagaggtctgatgccacatttgcactttgagcaaaaacacacagttactttaatcaccctcgaaatacctatctgtagttgttttattcaattatgttttgtcctatccatagaacttgggcagctcaacttgagtgttgatacctacaaaattgtgaggctaaggtcacatgtgatgtggctgttgcttcgagaggaagcagtaaatctttattggaatgccagggttcctttgtgtagccactgatgattctctatggtagccaggaagacttgtgtgtgctgggctggtagtaatacaagaggtaaccccaggacagtttctgcacaatgaagttgtacaagtagagctccagaaaaatgtctctctcctctgacctttatttaaagaagggacaacaagtgtcttgacttctttccctttcctccttagggaagacattcttccaagtatcaagaaagggagcccttgattccctggaagacatttcgtcccagcattccctctccagttccatgtgaccattcctactctgagccagttttggaaaggaaggtaagtggttggattaggttaggtgatatccaagtagaggtagccgaattctgtcttggactgggtcaatgatgacaacccaatgtcatgaagaaaggtgatgacataaaattcatgctcaataggattacgctgaggcaaaaccagggcgacagggtcacaagagctccttgggggggctctagggtgacttccctgaagtcctcagatgcccttgccctgtttccgatgagaggaaatgtggacatctagggtgcacattggttggcaaacactgcatgccaacaagcacctagtcccacaatggaaccttaggcatttctgcaaggatcgccccttgctcatgacaatgtcttttctggtgttttgcagtcatctcacatgccaccttggaaggcagagcaacacagataatcaggtaagtggtcagaacatggtaaagcctccacatccaggtgacctcccccttcatgatttggctttcaattctcagccagtctgtccatttggaattagggataacaaaatggtatacaacggtaccaaaggagctcgatttaggctatgttctccgatgtacatcccctggtttgtaacgttttaaggaatgtgttcaactccggataattgttttttcataattttgacctacttctcatggagagaggaggatgacattttttgaatgttgggatctcagactttgatgcttacaattttatggcaaatagctacaggaggacaacactggcctccaggacgttatgggactcttcctttcttttgacaggggaggcccaagtgacagatcctttcttagggaaaaagaaggattctatgatatccaaaaaggctgtcctccccaggatgggtttacaaagggcaattcctctagcagatattccaaagatctcaccccagagaaaatttacccatgtggatagggtgagatattcatttttaccttggtgcccaccacattctaaatttccttcatggtatcatttagggcacttactgaacctcactgcagaatcactgaggaaaaaaagctctacacattaggttgatacagggtaatgccaggtgtttaaagaacctaattgcactttgattcataacaccaaggcctgacttgagtccagcaacaacggttaccctcacgttttacagcagggcaacccataacaccttgacacaaatggatccatgtatacacatgggttttgtggcttggggccaggattctcgggagattttcaggaatcacctttcacgttgagttgggtcttacaacatagaccttacagaggtctgatgccacatttgcactttgagcaaaaacacacagttactttaatcacccttgaaatacctatctgtagttgttttattcaattatttttttgtcctatccatagaacttgggcagctcaacttgagtgttgatacctacaaaatggtgaggctaaggtcacctgtgatgtggctgttgcttcgagaggaagcagtaaatcttattggaatgccagggttcctttgtgggttccactgatgtttctgtatggtagccaggaagacttgtgtgtgctgggctggtagtaataaatgaggtaaccccaggacaatttctgcacaatgaagttgtaccagtagagctccagaaaaatgtctctctcctcaaacctttatttaaagatgggacaacaagcgtcttgtcttctttccctttcctccttaggaaagacattcttccaagttgcttccctggaagacatttcatcccagcaatccctctccagttccatgtgaccatttctactctgagccagttttggaaaggaaggtaagtggttggattaggttaggtgatatccaagtagaggtagccgaattctgtctaggactgggtcaatgatgacaacccaatgtcatgaagaaagttgatgacataaaattcatgctcaataggattacactgagccccaaccagggcgacagagtcacaagaggtccgttgactccttggggggctcttgggtgacttccctgaagtcctcagatgcccttgccctgtttcccatgagaggaaatgtggacatctagggtgcacattggttgacaaacactgcatgccaacaagcacctagtcccacaatagaaccttgggcatttctgcaaggatagccccttgctcatgacaatgtcttttctggtgttttgcagtcatctcacatgccaccttggaaggcagagaaacacagataatcaggtaagtggtcagaacatggtaaatcctccacatccaggtgacctcccccttcatgatttggctttcaattctcagccagtcggtccttttggaattagggataacaaaatggtatacaacggtaccaaaggagctcgatttaggctatgttctccgatgtacatcccctggtttgtaacgttttaaggaatgtgttcaactcccgataattgttttttcataattttgacctacttctcatggagagaggaggatgacattttttgaatgttgggatctcatactttgatgcttacaattccatggcaaatagcttcaggaggacaacacaggcctccagggcctaatgggagtcttcctttcccttgaaaggagaggcccaagtgacagaccctttcttagggaaaaagaaggattctatgatatccaaaaaggttgtcctccccaggatgggttcacaaagggcaatccctctagcagatattccaaagatctcaccccagagacaatttaccaatgtggatagggtgagatattcatttttaccttggtacccaccacattccaaatttccttcttggtatcatttagggcacttactgaacctcactgcagaatcactgaggaaaaaaagctctacacattaggttgatacagggtaagaccaggtgtttaaagaacctaattccactttgattcataacaccaaggcctgactttagtccagtaacagtgcttactctcacggtttacagcagggcaacccataacacgttgacaaaaatggatacatgtatagacatgggttctgtggcctcggtccaggattctcgggagattttcaggaatcacctttcacgttgagtcgggtcgtacaacatagaccttacagaggtctgatgccacatttgcactttgagcaaaaacacacagttactttaatcaccctcgaaatacctatctgtagttgttttattcaattacttttttgtcctatccatagaacttgggcagctcaacttgagtgttgatacctacaaaatggtgaggctaaggtcacctgtgatgtggctgttgcttcgagaggaagcagtaaatctttattggaatgccagggttcctttgtgtgtccactgatgtttctctatggttgccaggaagacttgtgtgtgctgggctggtagtaatacaagatgtaaccccaggacagtttctgcacaatgaagttgtacaagtagagctccagaaaaatgtctctctcctctgacctttatttaaagaagggacaacaagcgtcttgacttctttccctttcctccttagggaagacattcttccaagtatcaagaaagggagcccttgcttccctggaagacatttcgtcccagcattccctctccagttccatgtgaccattcctactctgagccagttttggaaaggaaggtaagtggttggattaggttaggtgatatccaagtagaggtagccaaattctgtctaggactgggtcaatgatgacaacccaatgtcatgaagaaaggtgatgacataaaattcatgctcaataggattacgctgaggcccaaccagggcgacagggtcacaagaggtccgttgactccttggggggctctagggtgatttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagcaacacagataatcaggtcagtggtcagaatatggtaaagcctccacatctaggtgaccttccttttcatgatttggctttcaattctcagccagtcggtccttttggaatcagggataacaaaatggtatacaacggtaccaaaggagctcgatttaggctatgttctcagatgtacatcccctggtttgtaacgttttaaggaatgtgttcaactcccgataattgttttttcataattttgacctatttctcatggagagaggaggatgacattttttgaatcttaggatctcatactttgatgcttacaattttatggcaaatagctacagtaggacaacacaggcctccagggacttatgggactcttcctttcccttaacaggggagtcccaagtgacagagcctttcttagggaaaaagaaggattctatgatatccaaaaagggtgtcctccccaggatgggttcacaaagggcaatccctctagcagatattctaaagatctcaccccagagacaatttacccatgtggaaagggtgaaatattcatttttaccttggtgcccaccacattccaaatttccttcatggtatcatttagggcacttactgaacctcacggcataatcactgaggaaaaaaagctctacacattaggttgatacagggtaaggccaggtgtttaaagaacctaattccactttgattcataacaccaaggcctgacttgagtccagcaacagtggttaccctcacgttttacagcagggcaacccatagcaccttgacacaaatggataaatgtgtagacatgggttctgtggcctgggcccaggattctcgggagattttcaggaatcacctttcacgttgagttggttcttacaacaaagaccttacagaggtctgatgccacatttgcactttgagcaaaaacacacacttactttaataccctcgaaatacctatctgtagttgttttattcaattaattttttgtcctatccatagaacttgggcagctcaacttgagtgttgatacctacaaaattttgaggctaaggtcacatgtgatgtggctgttgcttcaagaggaagcagtaaatctttattggaatgccagggttcctttgtgtggccactgatgtttctctattgtagccaggaagacttgtgtgtgctgggctggtagtaatacaagaggtaaccccaggacagtttctacacaatgaagttgtaccagtacagctccagaaaaatgtctccctcctctgacctttattaaagaagggacaaaaagcacctcaacttctttccctttcctccttagggaagacattcttccaagtatcaagagagggagcccttgcttcactggaagacatttcttcccagtaatcactctccagttccatgtgacctttcctaatctgagccagttttggaaaggaaggtaaatggttggattaggttaggtgatatccaagaagaggtagccgaattctgtctaggactgggtcaatgatgacaacacaatgtcatgaagaaaggtgatgacataaaattcatgctcaataggattatgctgaggcccaaccagggcaacagggtcatagaggtcggttgactttttggggggctcttgggtgatttccctgaagtcctcagatgcccttgccctgtttcccatgagaggaaatgtggacatctagggtgcacattggttggcaaacactgcatgccaacaagcacctagtcccaaaatggaacattgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaattagggataacaaaatggtatacaacggtaccaaaggagctcgatttaggctatgttctccgatgtacatcccttggtttgaaacgttttaaggaatgtgttcaactcccgataattgtttttccataattttgtcctacttctcattgtgagaggagcatgacattttttgaatcttaggatctcatactttgatgcttacaattccatggcaaatagctacttgaggacaatacaggcctccagggccttatgggactcttcctttcccttgacaggggaggcccaagtgacagagtctttcttagggaaaaagaaggattctgtgatatccaaaaaggctgtcctccccaggatgggttcacaaagggcaatccctctagcagatattccaaagatctcaccccagagacaatttaccaatgtggatagggtgagatattcatttttaccttggtacccaccacattccaaatttccttcatggtatcatttagggcacttactgaacctcactgcagaatcattgaggaaaaaaagctctacacattaggttgatacagggtaaggccaggtgtttaaagaacctaattccactttgattcataacaccaaggcctgactttagtccagcaacagtgcttacaatcatggtttacagcagggcaacccataacacgttgacacaaatggatatatgtatagacatgggttctgtggcctcggtccaggattctcgggagattttcaggaatcacctttcacgttgagttgggtcgtacaacatagactttacagaggtctgatgccacatttgcactttgagcaaaaacacacagttactttaatcaccctcgaaatacctatctgtagttgttttattcaattacttttttgtcctatccatagaacttgggcagctcaacttgagtgttgatacctacaaaatggtgaggctaaggtcacctgtgatgtggctgttgcttcgagaggaagcagtaaatctttattggaatgccagggttcctttgtgtgtccactgatgtttctctatggtagccaggaagacttgtgtgtgctggtctggtagtaatacaagaggtaaccccaggacagtttctgcacaatgaagttgtacaagtagagctccagaaaaatgtctctctcctctgacctttatttaaagaagggacaacaagcgccttgaattctttcccattcctccttagggaagacattcttccaagtatcaagaaagggagcccttgcttccctggaagacatttcgtcccagtaatcactctccagttccatgtgaccattcctactctgagccagttttggacaggaaggtaagtggttggattaggttaggtgatatctaagtagaggtagccgaattctgtctaggactgggtcaatgatgacaacccaatgtcatgaagaaaggtgatgacataaaattcatgctcaataggattacgctgaggcccaaccagggcgacagggtcacaagaggtccgttgactccttggggggctctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagcaacacagataatcaggtaagtggtcagaacatggtaaagcctccacatccaggtgacctcccccttcatgatttggctttcaattctaagccagtctgtccttttggaatttggggataacaaaatggtatgcaaaggttccaaaggagcctgatttaagctatgttctccgatgtacatcccctggtttataacgttttaaggaatgtgttcaactcccgataattgctttttcataattttgacctacttctcattgagagaggagcatgacattttttgaatcttaggttctcatactttgatgcttacaattttatggccaatagctacagtaggacaacacaggcctccagggaattatgggactcttcctttcccttaacaggggagtcccaagtgacagagcctttcttagggaaaaaaaaggattctatgatatccaaaaagggtgtcctcccaagatgggttcacaaagggcaatccctctagcagatattctaaagatctcaccccagagacaatttacccatgtggaaagggtgagatataaatttttaccttggtacccaccacattccaaatttccttcatggtatcatttagggcacttactgaacctcactgcagaatcactgaggaaaaaaagctctacacattaggttgatacagggtaaggccaggtgtttaaagaacctaattccactttgattcataacaccaaggcctgactttagtccagcaacagtgcttacaatcatgttttacagcaaggcaaccataacacgttgacacaaatggatacatgaatagacatgggttctgtggcctcggtccaggattctcgggagattttcaggaatcacctttcacgttgaatcggatcctacaacatagaccttacagaggtctgatgccacatttgcactttgagcaaaaacacacagttactttaatcgccctcgaaatacctatctgtagttgttttattcaattatttttttgtcctatccatagaacttgggcagctcaacttgagtgttgatacctacaaaatggtgaggctaaggtcacctgtgatgtggctgttgcttcgagaggaagcagtaaatctttattggaatgccagggttcctttgtgtgtccactgatgtttctctatggtagccaggaagacttatgtgtgctgggctggtagtaatacaagaggtaaccccaggacagtttctgcacaatgaagttgtacaagtagagctccagaaaaatgtctctttcctctgacctttatttaaagaagggacaacaagcgccttgacttctttccctttcctccttagggaagacattcttccaagtatcaagaaagggaacccttgcttccctggaagacatttcgtcccagcaatccctctacagttccatgtgaccattcctactctgagccagttttggaaaggaaggtaagtggttagattaggttaggtgatatccaagtagaggtagccgaattctgtctaggactgggtcaatgatgacaacccaatgtcatgaagaaaggtgatgacataaaattcatgctcaataggattacgctgaggcccaaccagggcgacagggtcacaagaggtccgttgactccttggggggctctagggtgacttccctgaagtcctcagatgcccttgccctgtttcccatgagaggaaatgtggacatctagggtgcacattggttgacaaacactgcatgccaacaagcacctagtcccacaatggaaccttgggcatttctgcaaggatcgccccttgctcatgacaatgtcttttctggtgttttgcagtcatctcacatgccaccttggaaggcagagcaacacagataatcaggtaagtggtcagaacatggtaaagcctccacatccaggtgacctcccccttcatgatttggctttcaattctcagcaagtcggtccttttggaatttggggataacaaaatggtatgcaaaggttccaaaggagctcgatttaagctatgttctccgatgtacatcccctggtttataacgttttaaggaatgtgttcaactccagataattgctttttcataattttgacctacttctcattgagagaggagcatgacattttttgaatcttaggatctcatactttgatgcttacaattttatggccaatagctacagtaggacaacacaggcctccagggaattatgggactcttcctttcccttaacaggggagtcccaagtgacagagcctttcatagggaaaaagaaggattctatgatatccaaaaagggtgtcctccccaggatgggttcacaaagggcaatccctctagcagatattctaaagatctcaccccagagacaatttacccatgtggaaagggtgagatattcatttttaccttggtacccaccacattccaaatttccttcatggtatcatttagggcacttactgaacctcactgcagaatcactgaggaaaaaaagctctacacattaggttgatacagggtaaggccaggtgtttaaagaacctaattccactttgattcataacaccaaggcctgactttagtccagcaacagtgcttacaatcacgttttacagcagggcaacccataacacgttgacgcaaatggatatatgtatagacatgggttctgtggcctcggtccaggattctcgggagattttcaggaatcacctttcacgttgagtcgggtcgtacaacatagaccttacagaggtctgatgccacatttgcactttgagcaaaaacacacagttactttaatcaccctcgaaatacctatctgtagttgttttattcaattaatttttgtcctatccatagaacttgggcagctcaacttgagtgttgatacctacaaaatggtgaggctaaggtcacctgtgatgtggctgttgcttcgagaggaagcagtaaatctttattggaattccagggttcctttgtgtgtccactgatgtttctctatggtagccaggaagacttgtgtgtgctgggctggtagtaatacaagaggtaaccccaggacagtttctgcacaatgaagttgtacaagtagagctccagaaaaatgtctctctcctctgacctttatttaaagaagggacaacaagcgccttgacttctttccctttcctccttagggaagacattcttccaagtatcaagaaagggagcccttgcttccctggaagacatttcgtcccagcaatccctctccaggtccatgtgaccattcctactctgagccagttttggaaaggaaggtaattagttggattaggttaggtgatatccaagtagaggtagccgaattctgtctaggactgggtcaatgatgacaacccaatgtcatgaagaaaggtgatgacataaaattcatgctcaataggattacgctgaggcccaaccagggcgacagggtcacaagaggtccgttgactccttggggggctctagggtgacttccctgaagtcctcagatgcccttgccctgtttcccatgagaggaaatgtggacatctagggtgcacattggttgacaaacactgcatgccaacaagcacctagtcccacaatggaaccttgggcatttctgcaaggatcgccccttgctcatgacaatgtcttttctggtgttttgcagtcatctcacatgccaccttggaaggcagagcaacacagataatcaggtaagtggtcagaacatggtaaagcctccacatccaggtgacctcccccttcatgatttggctttcaattctcagccagtctgtccttttggaatttggggataacaaaatggtatgcaaaggttccaaaggagctcgatttaagctatgttctccgatgtacatcccctggtttataacgttttaaggaatgtgttcaactccatataattgctttttcataattttgacctacttctcattgagagaggagcatgacattttttgaatcttaggatctcatactttgatgcttacaattttatggccaatagctacagtaggacaacacaggcctccagggacttatgggactcttcctttcccttaacaggggagtcccaagtgacagagcctttcatagggaaaaagaaggattctatgatatccaaaaagggtgtcctccccaggatgggttcacaaagggcaatccctctagcagatattctaaagatctcaccccagagacaatttacccatgtggaaagggtgagatattcatttttaccttggtacccaccacattccaaatttccttcatggtatcatttagggcacttactgaacctcactgcagaatcactgaggaaaaaaagctctacacattaggtagatacagggtaaggccaggtgtttaaagaacctaattccactttgattcataacaccaaggcctgactttagtccagcaacagtgcttacaatcacgttttacagcagggcaacccataacacgttgacgcaaatggatatatgtatagacatgggttctgtggcctcggtccaggattctcgggagattttcaggaatcacctttcacgttgagtcgggtcgtacaacatagaccttacagaggtctgatgccacatttgcactttgagcaaaaacacacagttactttaatcaccctcgaaatacctatctgtagttgttttattcaattaatttttgtcctatccatagaacttgggcagctcaacttgagtgttgatacctacaaaatggtgaggctaaggtcacctgtgatgtggctgttgcttcgagaggaagcagtaaatctttattggaatgccagggttcctttgtgtgtccactgatgtttctctatggtagccaggaagacttgtgtgtgctgggctggtagtaatacaagaggtaaccccaggacagtttctgcacaatgaagttgtacaagtagagctccagaaaaatgtctctctcctctgacctttatttaaagaagggacaacaagcgccttgacttctttccctttcctccttagggaagacattcttccaagtatcaagaaagggagcccttgcttccctggaagacatttcgtcccagcaatccctctccaggtccatgtgaccattcctactctgagccagttttggaaaggaaggtaattagttggattaggttaggtgatatccaagtagaggtagccgaattctgtctaggactgggtcaatgatgacaacccaatgtcatgaagaaaggtgatgacataaaattcatgctcaataggattacgctgaggcccaaccagggcgacagggtcacaagaggtccgttgactccttggggggctctagggtgacttccctgaagtcctcagatgcccttgccctgtttcccatgagaggaaatgtggacatctagggtgcacattggttgacaaacactgcatgccaacaagcacctagtcccacaatggaaccttgggcatttctgcaaggatcgccccttgctcatgacaatgtcttttctggtgttttgcagtcatctcacatgccaccttggaaggcagagcaacacagataatcaggtaagtggtcagaacatggtaaagcctccacatccaggtgacctcccccttcatgatttggctttcaattctcagccagtctgtccttttggaatttggggataacaaaatggtatgcaaaggttccaaaggagctcgatttaagctatgttctccgatgtacatcccctggtttataacgttttaaggaatgtgttcaactccatataattgctttttcataattttgacctacttctcattgagagaggagcatgacattttttgaatcttaggatctcatactttgatgcttacaattttatggccaatagctacagtaggacaacacaggcctccagggacttatgggactcttcctttcccttaacaggggagtcccaagtgacagagcctttcatagggaaaaagaaggattctatgatatccaaaaagggtgtcctccccaggatgggttcacaaagggcaatccctctagcagatattctaaagatctcaccccagagacaatttacccatgtggaaagggtgagatattcatttttaccttggtacccaccacattccaaatttccttcatggtatcatttagggcacttactgaacctcactgcagaatcactgaggaaaaaaagctctacacattaggttgatacagggtaaggccaggtgtttaaagaacctaattccactttgattcataacaccaaggcctgactttagtccagcaacagtgcttacaatcatgttttacagcagggcaacccataacaccttgacacaaatggatataagtatagacatgggttctgtggcctcggtccaggattctcgggagattttcaggaatcacctttcacgttgagtcgggtcgtacaacatagaccttacagaggtctgatgccacatttgcactttgagcaaaaacacacagttactttaatcaccctcgaaatacctatctgtagttgtgttattcaattattttttgtcctatccatagaacttgggcagctcaacttgagtgttgatacctacaaaatggtgaggctaaggtcacctgtgatgtggctgttgcttcgagaggaagcagtaaatctttattggaatgccagggttcctttgtgtgtccactgatgtttctctatggtagccaggaagacttgtgtgtgctgggctggtagtaatacaagaggtaaccccaggacagtttctgcacaatgaagttgtacaagtagagctccagaaaaatgtctccctcctctgacctttattaaagaagggacaaaaagcgcctcgacttctttccctttcctccgtagggaagacattcttccaagtatcaagaaagggagcccttgcttcactggaagacatttcgtcccagtaatcactctccagttccatgtgacctttcctaatctgagccagttttggaaaggaaggtaaatggttggattaggttaggtgatatccaagtagaggtagccgaattctgtctagaactgggtcaatgatgacaacccaatgtcatgaagaaaggtgatgacataaaattcatgctcaataggattacgctgaggcccaaccagggcgacagggtcacaagagctccgttgactccttcgggggctctagggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaatatggtaaagcctccacatcaaggtgccctcccccttcatgatttagctttcaattctcagccagtctgtccttttggaattttgggataacaaaatggtatgcaacagtaccaaaggagctcgatttaggctatgttctcagatgtacatcccctggtttgaaacgttttaaggaatgtgttcaactcccgataattttttttccataattttgtcctacttctcattgtgagaggagcatgacattttttgaatcttaggatcttatactttgatgcttacaattcaatggcaaatagctacaggaggacaatacaggcctccagggtcttatgggactcttcctttcccttgacaggggaggcccatgtgacaaagtcttttttagggaaaaagaaggattctgtgatatccaaaaaggctgtcctccccaggatgggttcacaaagggcaatccctctagcagatattccaaagatctcaccccagagacaatttacccgtgtggaaagggttagatattcatttttaccttggtgcccaccacattccaaatttccttcatggtattatttagggcacttactgaacctcactgcagaatcactgaggaaaaaaagctctacacattaggtagatacagggtaaggccaggtgtttaaagaacctaattccactttgatttataacaccaaggcctgattgagtccagcaacagtggttaccctcacattttacagcagggcaacccataactccttgacacaaatggatccatgtatagtcatgggttctgtggcctgggcccaggattctcgggagattttcaggaatcagcttttacgttgagtcgggccgtacaacatagaccttacagaggtctgatgccacatttgcacgttgagcaaaaacacacaatttctttaatcaacctcgaattacctatctgtagttgttttattcaattatttttttgtcctatccatagaatttgggcagctcaacttgagtgttgatacctacaaaattgtgaggctaaggtcacatgtgatgtggctgttgcttcgagaggaagcagtaaatctttattcgaatgccaggtttcctttgtgtgtccactgatgtttctctatggtagcagggaagacttgtgtgtgctgggcaggtagtaatacaacagataaccccaggacagtttctgcacaatgaagttgtgccagtagagctccagagaaaagtctctctcctctgacctttatttaaagaagggacaacaagcgccttgacttttttccctttcctccttagggaagaccttcttcaaagtatcaagaaagggagcccttgcttccctggaagacatttcgtcccagcaatccctctccagttaaatgttaccattcctactctgagccagttttggaaaggaaggtaagtggttggattaggttaggtgatatccaagtagaggtagccgaattctgtctaggactgggtcaatgatgacaacccaatgtcatgaagaaaggtgatgacataaaatgcaatccccattaaaattccaactcaattcttcaacgaattagaaggagcaatttgcaaattcatctggaataacaaaaaaccgaggatagcaaaaactcttctcaaggataaaagaacctctggtggaatcaccatgcctgacctaaagctttactacagagcaattgtgataaaaactgcatggtactggtatagagacagacaagtggaccaatggaatagaattgaagacccagaaatgaacccacacacctatggtcacttgatcttcgacaagggagccaaaaccatccagtggaagaaagacagcattttcaacaattggtgctggcacaactggttgttatcatgtagaagaatgcgaatcgatccatacttatctccttgtactaaggtcaaatctaagtggatcaaggaacttcacataaaaccagagacactgaaacttatagaggagaaagtggggaaaagccttgaagatatgggcacaggggaaaaattcctgaacagaacagcaatggcttgtgctgtaagatcgagaattgacaaatgggacctaatgaaactccaaagtttctgcaaggcaaaagacactgtctataagacaaaaagaccaccaacagactgggaaaggatctttacctatcctaaatcagataggggactaatatccaacatatataaagaactcaagaaggtggacctcagaaaatcaaataacccccttaaaaaatggggctcagaactgaacaaagaattctcacctgaggaataccgaatggcagagaagcacctgaaaaaatgttcaacatccttaatcatcagggaaatgcaaatcaaaacaaccctgagattccacctcacaccagtgagaatggctaagatcaaaaattcaggtgacagcagatgctggcgaggatgtggagaaagaggaacactcctccattgttggtgggattgcaggcttgtacaaccactctggaaatcagtctggcggttcctcagaaaattggacatagtactaccggaggatccagcaatacctctcctgggcatatatccagaagaagccccaactggtaagaaggacacatgctccactatgttcatagcagccttatttataatagccagaaactggaaagaacccagatgcccctcaacagaggaatggatacagaaaatgtggtacatctacacaatggagtactactcagctattaaaaagaatgaatttatgaaattcctatccaaatggatggacctggagagcatcatcctgagtgaggtaacacaatcacaaaggaactcacacaatatgtactcactgataagtggatactagcccaaaacctaggatacccacgatataagatacaatttcctaaacacatgaaactcaagaaaaatgaagactgaagtgtggacactatgcccctccttagaagtgggaacaaaacacccatggaaggagttacagaaacaaagtttggagctgagatgaaaggatggaccatgtagagactgccatatccagggatccaccccaaaatcagcatccaaacgctgacaccattgcatatactagcaagattttatcgaaaggacccagatgtagctgtctcttgtgagactatgccggggcttagcaaacacagaagtggatgctcacagtcagctaatggatggatcacagggctcccaatggaggagctagagaaagtacccaaggagctaaagggatcttcaaccctataggtggaacaacattatgaactaaccagtacccctgagctcttgactctagctgcatatgtatcaaaagatggcctagtcggccatcactggaaagagaggcccattggacacgcagactttgtgtgccccggtacaggggaacgccagggccaaagggggggagtgggtgggtaggggagtgggggtgggtgggtaagggggacttttggtatagcattggaaatgtaaatgagctaaatacctaataaaaaatggaaaaaaaaaggaaaaaaaaaaataaaaattttctctaaaacaataaaaaaaaaaaaaaaaaattcattctcaataggattacgctgaggcccaaccagtgcgacagggttacaagagatccattgactttttggggagctcttgggtcacttccctgaagtcctcagatgcccttgccctgtttcccatgagaggaaatttggacatctagggtgcacattggttggcaaacactgcatgccaacaagcacctagtcccacaatggaaccttgggcatttctgcaagaatcgcaccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtctgtccttttggaattagggataacaaaatggtatgcaacggtaccaaaggagctctatttaggctatgttctccgatgtacatcccctggtttgtaacggtttaaggaatgtgttcaactcccgacaaatgttttttcataattttgacctacttctcaaggagagaggaggatgacgttttttgaatattggcatctcatactgtgatgcttacaattccatggcaaatagctacaggaggacaacacaggcctccagggccttatgggactcttcctttcccttgacaggggaggcccaagtgacagagcctttcttagggaaaaaaaaaggattctatgatatccaaaaaggctgtcctccccaggatgggttcacaaagggcaatgcctctagcagatattccaaagatctcaccccagagacaatttacccatgtggaaagggtgagatattaatttttaccttggtgcccaccacattccaaatttccttcatggtatcatttggggtacttactgaacctcactgcagaatcactgaggaaaaaaagctctacacattaggttgatacaaggtaaggccaggtgtttaaagaacctaattgcatttgattcataacaccaaggcctgacttgagtccagcaacagtggttaccctcaagttttacagcagggcaacccataacaccttgaaacaaatggatccatatatagacatgggttctgtggcctggtcccaggattctcgggagattttcaggaatcacctttcacgttgagtcgggtattacaacatagaccttacagaggtctgatgccacatttgcactttgagcaaaaacacacagttactttaatcaccctcgaaatacctatctgtagttgtttaattcaataatttttttgtcctatccatatgacttggacagctcaacttgagtgttgatacctacaaaattgtgaggctaaggtcacatgtgatgtggctgttgcttcgagaggaagcagtaaatctttattggaatgccagggatcctttgtgtgtccactaatgtttctctatggtagccaggaagacttgtgtgtgctgggctggtagtagtacaagaggtaaccccagaacagtttctgcacaatgaagttgtgctagtagagctccagaaaaatgtctctctcctctgacctttatttaaagaagggacaacaagcgccttgacttctttccctttcctccttagggaagacattcttccaagtatcaagaaagggagcccttgcttccctggaagacatttcatcccagcaatccctctccagttccatgtgaccattcctactctgagccagttttggaaaggaaggtaagtggctggattaggttaggtgatatccaagtagaggtagccgaattctgtctaggactgggtcaatgatgacaacccaatgtcatgaagaacggtgatgacataaaattcatgctcaataggattacgctgaggcccaactagggcgacagggtcacgagaggtccattgactctttggggggctcttgggtgacttccctgaagtcctgagatgcccttaccctgtttcccatgagaggaaatgtggacatctagggtgcacattggttggcaaacactgcatgccaacaaacacctagtcccacaatggaaccttgggcatttctgcaaggatcgccccttgctcatgacaatgtcttttctggtgttttgcagtcatctcacatgccaccttggaaggccgagaaacacagataatcaggtaagtggtcagaacatggtaaagcctccacatccaggtgacctcccccttcatgatttggctttcaattctcagccagtctgtttttttggaaatagggataacaaaatggtatgcaacggtaccaaaggagctcgatttaggctatgttctccgatgtacatcccctggtttgtaacggtttaaggaatgtgttcaactcctgacaattgttttttcataattttaacctacttctcaaggagagaggaggatgacattttttgaatattggcatctcatactgtgatgcttacaattccatggcaaatagctacaggaggacaacacaggcctccagggccttatgggactcttcctttcccttgacaggggaggcccaagtgacagagcctttcttagggaaaaaaaaggattctatgatatccaaaaaggctgtcctccccagggtgggttcacaaagggcaatgcctctagcagatattccaaagatctcaccccagagacaatttacccatgtggaaagggtgagatattaatttttaccttggtgcccaccacattccaaatttccttcatggtatcatttggggtacttactgaacctcactgcagaatcactgaggaaaaaacgctctacacattaggttgatacagggtaaggccaggtgtttaaacaacctaattccactttaattcataacaccaaggcctgacttgagtccagcaacagtggctaccctcaagttttacagcagggcaacccataacaccttgaaacaaatggatccatgtatagacatgggttctgtggcctgggcccaggactctcgggagattttcaggaatcacctttcacgttgagtcgggccttacaacatagaccttacagaggtctgatgccacatttgcactttgaacaaaaacacacagttactttaatcaccctcgaaatacctatctgtagttgtttaattcaataatttttttgtcctatccatatgacttggacagctcaacttgagtgttgatacctacaaaattgtgaggctaaggtcacatgtgatgtggctgttgcttcgagaggaagcagtaaatctttattggaatgccagggttcctttgtgtgtccactgatgtttctctatggtagccaggaagacttgtgtgtgctgggctggtagtagtacaagaggtaaccccaggacagtttctgcacaatgaagttgtgccagtagagctccagaaaaatgtctctctcctctgacctttatttaaagaagggacaacaagcgccttgacttctttccctttcctccttagggaagacattcttctaagtatcaagaaagggagcccttgcttccctggaagacatttcatcccagcaatccctctccagttccatgtgaccattcctactctgagccagttttggaaaggaaggtaagtggctggattaggttaggtgatatccaagtagaggtagccggattctgtctaggactgggtcaatgatgacaacccaatgtcatgaagaacggtgatgacataaaatacatgctcaataggattacgctgaggccaaaccagggcgacagagtcacaagaggtccgttgactccttggggggctcttgggtgacttccctgaagtcctcagatgctcttgccctgtttcccatgagaggaaatatggatatctagggtgcacattatggcaaacactgcatgccaacaagcaactagtcccacaatggaaccttgggcatttctgcaaggatcgcaccttgctcatgacaatgtcttttctggtgttttgcaatcatctcacatgccaccttggaaggcagagaaacacagataatcaggtaagtggtcagaacatggtaaagcctccacatccaggtgacctcccccttcatgatttggctttcaattctcagacagtctgtccttttggaattagggataacaaaatggtatgcaacggtaccaaaggagcttgatagaggctatgttttccgaagtacattccctggtttgtaacattttaaggaatgtgttcaactcccgacaattgttttttcataattttgacctacttctcattgagagaggaggatgacattttttgaatattggcacctcatactttgatgcttacaattccattggaaatagcttcaggaggacaacacaggcctccagggccttatgggactcttcctttcccttgacaggggaggcccaagagacagagcgtttcttagggaaaaagaaggattctatgatatccaaaaaggctgtcctccccaggatgggttcacaaagggcaatccctctagcagttattccaaagatctcacctcagagacaatttacccatgtggaaagggtgaaatattcatttttaccttggtgcccaccacattccaaatttccttcatggtgtcatttagggcaattactgaacctcactgcaaaatcactgaagaaaaaaagctctacacattagtttgatacagggtaaggccaggtgtttaaagaacgaaattccactttgattcataacaccaaggcctgacttgagtccagcaacagtggctaccctcaagttttacagcatggcaacccataacaccttgacacaaatggacccatgtatagacatgggttctgtggcctgggccaggattctcgggagattttcaggaatcacctgtcaagttgagtcgggccttacaacatagaccttacagagttctgatgccacatttgcactttgagcaaaaacacacagttactttaatcaccctcgaaatacctatctgtagttgttttattcaattatttttttgtcctatccatagaacttgggcagctcaacttgagtgttgatactacaaaattgtgaggctaaggtcacatgtgatgtggttgttgcttcgagaggaagcagtaaatctttattggaattccagggatcctttgtgtgtccactgatgtttctatatggtagccaggaagacttgtgtgtgctgggctggtagtaatacaagaggtaaccccaggacagtttctccacaatgaagttgtgccaatagagctccagaaaaatgtctctctcctctgacctttatttaaagaagggacaacaagtgccttgacttctttccctttcctccttagggaagacattcttccaagtatcaagaaagagagcccttgcttccctggaagacatttcgtcccagcaatcactctccagttccatgtgaccattcctactctgagccagttttggaaaggaaggtaagtggttggatttgattaggtgatatccaagtagaggtagccgaattctgtctaggactgggtcaatgatgaaaacccaatgtcatgaagaaaagtgatgacataaaattcatgctcaataggattaccctgaggcccaaccagggtgacagggttacaagaggtccattgactccttggggggctcttgggtgacttccctgaagtcctcagatgcccttgccctgtttcccatgagaggaaatgtggacatctagggtgcacattggttggcaaacactgcatgccaacaggcacctagtcccacaatggaaccttgggcatttctgcaaggatcgcaccttgctcatgacaatgtcttttctgttgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaatttggggataacaaaattgtatgcaaaggtaccaaaggagctcgatttaggctatgttctccgatgtacatcccctggtttgtaacattttaaggaatgtgttcaactccctataattgttttttcataattttgacctacttatcatggagagaggaggatgacattttttgaatattggcatctcatactttgatgcttacaattccatggcaaataactacaggaggacaacactggcctccagggccttatgggactcttcctttcccttgacaggggaggcccatgtgacagagcctttcttagggcaaaaaaaggattctatgatatccaaaaaggctgtcctccccaggatgggttcataaagggcaatcactctagcagatattccaaagatctcaccccagagacaatttacccatgtggaaagggtgagatattaatttttaccttggtgcccaccacattccaaatttccttcattttatcatttggggcacttactgaacctcactgcagaatcactgaggaaaaaaagctctacacattagtttgatacagggtaaggccaggtgtttaaagaacctaattccactttgattcataacaccaagccctgacttgagtccagcaacagtggttactctcaagttttacagcagggcaacccataacaccttgacacaaatggacccatgtatagacatgggttctctggcctgggccaggattctcgggagattttcaggaatcacctgtcacgttgagtcgggccttacaacatagaccttacagaggtctgatgccacatttgcactttgagcaaaaacacacagttactttaatcaccctcgaaatacctatctgtagttgttttattcaattatttttttgtcctatccatagaacttgagcagctcatcttgagtgttgatacctacaaaattgtgaggctaaggtcacaagggatgtggctgttgcttcgagaggaagcagtaaatctttattggaattccagggatcctttgcgtgccctctgatgtttctgtatggtagccaggaagacttgtgtgtgctgggctggtagtaatacaagaggtaaccccaggacagtttctgcacaatgaacttgtgccagtagagctccagaaaaatgtctctctcctctgacctttatttaaagaagggacaacaagcgccttgacttctttccctttcctccatagggaagacattcttccaagtatcaagaaagggagcccttgcttccatggaagatatttcctcccaacaatccctctccagttcaatgtgaccattcctactctgagccagttttggaaaggaaggtaagttgttggattaggttaggtgatatccaagtaggggtagccgaattctgtctaggactgggtcaatgatgacaacccaatgtcatgaagaaagttgatgacataaaattcatgctcaataggattacactgagccccaaccagggcgacagagtcacaagaggtccgttgactccttggggggctcttgggtgacttccctgaagtcctcagatgctcttgccctgtttcccatgagaggaaatatggatatctagggtgcacattggttggcaaacactgcatgccaacaagcacctagtcccacaatggaaccttgggcatttctgcaaggatcgcaccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagacagtctgtccttttggaattagggataacaaaatggtatgcaacggtaccaaaggagcttgatagaggctatgttttccgaagtacatcccctggtttgtaacattttaaggaatttgttcaactcccgacaattgttttttcataattttgacctacatctcattgagagaggaggatgacatttttgaatattggcacctcatactttgatgcttacaattccactggaaatagcttcaggaggacaacactggcctccagggccttatgggtctcttcctttcccttgacaggggaggcccaagagacagagcgtttcttagggcaaaaaaaggattctatgatatccaaaaaggctgtcctccccaggatgggttcataaagggcactccctctagcagttattccaaagatctcaccccagagacaatttacccatgtcgaaagggtgaaatattcatttttaccttggtgcccaccacattccaaatttccttcatggtgtcatttagggcacttactgaacctcactgcagaatcactgaggaaaaaaagctctacacattagtttgatacagggtaaggccaggtgtttaaagaacgaaattccactttgattcataacaccaaggcctgacttgagtccagcaacagtggttaccctcacgttttacagcatggcaacccataacaccttgacacaaatggacccatgtatagacatgggttctgtggcctgggccagatttctcgggagattttcaggaatcacctgtcacgttgagtcgggccttacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatactacaactttgtgaggctaaggtcacctgtgatgtggctgttgcttcgagaggaagcagtaaatctttattggaattccagggatcctttgtgtgtccactgatgtttctatatggtagccaggaagacttgtgtgtgctgggctggtagtaatacaagaggtaaccccaggacagtttctccacaatgaagttgtgccaatagagctccagaaatatgtctctctcctctgacctttatttaaaaaagggacaacaagcgccttgacttctttccctttcctccttagggaagacattcttccaagtatcaagagagggagcccttgcttccctggaagacatttcgtcccagcaatcactctccagttccatgtgaccattcctactctgagccagttttggaaaggaaggtaagtggttggatttgattaggtgatatccaagtagaggtagccgaattctgtctaggactgggtcaatgatgaaaacccaatgtcatgaagaaaagtgatgacataaaattcatgctcaataggattacgctgaggcccaaccagggcgacagggttacaagaggtccattgactccttggggggctcttgggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgcaccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttcgctttcaattctcggccagtcggtccttttggaatttggggataacaaaatggtatgcaaaggtaccaaaggagctcgatttaggctatgttctccgatgtacatcccctggtttgtaacgatttaaggaatgtgttcaactccctataattgttttttcataattttgacctacttctcatggagagaggaggatgacattttttgaatattggcatctcatactttgatgcttacaattccatggcaaataactacaggaggacaacactggcctccagggccttatgggactcttcctttcccttgacaggggaggcccatgtgacagagcctttcttagggcaaaaaaaggattctatgatatccaaaaaggctgtcctccccaggatgggttcataaagggcaatcactctagcagatattccaaagatctcaccccagagacaatttacccatgtggaaagggtgagatattaatttttaccttggtgcccaccacattccaaatttccttcatggtatcatttggggcacttactgaacctcactgcagaatcactgaggaaaaaaagctctacacattagtttgatacagggtaaggccaggtgtttaaagaacctaattccactttgattcataacaccaagccctgacttgagtccaggaacagtggttactctcaagttttacagcagggcaacccataacaccttgacacaaatggacccatgtatagacatgggttctctggcctgggccaggattctcgggagattttcaggaatcacctgtcacgttgagtcgggccttacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatactacaactttgtgaggctaaggtcacatgtgatgtggctgttgcttcgagaggaagcagtaaatctttattggaattccagggatcctttgtgtgtccactgatgtttctatatggtagccaggaagacttgtgtgtgctgggctggtagtaatacaagaggtaaccccaggacagtttctccacaatgaagttgtgccaatagagctccagaaatatgtctctctcctctgacctttatttaaaaaagggacaacaagcgccttgacttctttccctttcctccttagggaagacattcttccaagtatcaagagagggagcccttgcttccctggaagacatttcgtcccagcaatcactctccagttccatgtgaccattcctactctgagccagttttggaaaggaaggtaagtggttggatttgattaggtgatatccaagtagaggtagccgaattctgtctaggactgggtcaatgatgaaaacccaatgtcatgaagaaaagtgatgacataaaattcatgctcaataggattacgctgaggcccaaccagggcgacagggttacaagaggtccattgactccttggggggctcttgggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgcaccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttcgctttcaattctcggccagtcggtccttttggaatttggggataacaaaatggtatgcaaaggtaccaaaggagctcgatttaggctatgttctccgatgtacatcccctggtttgtaacgttttaaggaatgtgttcaactccctataattgttttttcataattttgacctacttctcatggagagaggaggatgacattttttgaatattggcatctcatactttgatgcttacaattccatggcaaataactacaggaggacaacactggcctccagggccttatgggactcttcctttcccttgacaggggaggcccatgtgacagagcctttcgtagggcaaaaaaaggattctatgatatccaaaaaggctgtcctccccaggatgggttcataaagggcaatcactctagcagatattccaaagatctcaccccagagacaatttacccatgtggaaagggtgagatattaatttttaccttggtgcccaccacattccaaatttccttcatggtatcatttggggcacttactgaacctcactgcagaatcactgaggaaaaaaagctctacacattagtttgatacagggtaaggccaggtgtttaaagaacctaattccactttgattcataacaccaagccctgacttgagtccagcaacagtggttactctcaagttttacagcagggcaacccataacaccttgacacaaatggacccatgtatagacatgggttctctggcctgggccaggattctcgggagattttcaggaatcacctgtcacgttgagtcgggccttacaacatagaccttacagaggtctgatgccacatttgcactttgagcaaaaacacacagttactttaatcaccctcgaaatacctatctgtagttgttttattcaattatttttttgtcctatccatagaacttgagcagctcatcttgagtgttgatacctacaaaattgtgaggctaaggtcacaagggatgtggctgttgcttcgagaggaagcagtaaatctttattggaattccagggatcctttgcgtgccctctgatgtttctgtatggtagccaggaagacttgtgtgtgctgggctggtagtaatacaagaggtaaccccaggacagtttctgcacaatgaacttgtgccagtagagctccagaaaaatgtctctctcctctgacctttatttaaagaagggacaacaagcgccttgacttctttccctttcctccatagggaagacattcttccaagtatcaagaaagggagcccttgcttccatggaagatatttcctaccaacaatccctctccagttccatgtgaccattcctactctgagccagttttggaaaggaaggtaagttgttggattaggttaggtgatatccaagtagaggtagccgaattctgtctaggactgggtcaatgatgacaacccaatgtcatgaagaaagttgatgacataaaattcatgctcaataggattacactgagccccaaccagggcgacagagtcacaagaggtccgttgactccttggggggctcttgggtgacttccctgaagtcctcagatgctcttgccctgtttcccatgagaggaaatatggatatctagggtgcacattggttggcaaacactgcatgccaacaagcacctagtcccacaatggaaccttgggcatttctgcaaggatcgcaccttgctcatgacaatgtcttttctggtgttttgcaatcatctcacatgccaccttggaaggcagagaaacacagataatcaggtaagtggtcagaacatggtaaagcctccacatccaggtgacctcccccttcatgatttggctttcaattctcagacagtctgtccttttggaattagggataacaaaatggtatgcaacggtaccaaaggagcttgatagaggctatgttttccgaagtacatcccctggtttgtaacattttaaggaatttgttcaactcccgacaattgttttttcataattttgacctacatctcattgagagaggaggatgacatttttgaatattggcacctcatactttgatgcttacaattccactggaaatagcttcaggaggacaacactggcctccagggccttatgggtctcttcctttcccttgacaggggaggcccaagagacagagcgtttcttagggcaaaaaaaggattctatgatatccaaaaaggctgtcctccccaggatgggttcataaagggcactccctctagcagttattccaaagatctcaccccagagacaatttacccatgtcgaaagggtgaaatattcatttttaccttggtgcccaccacattccaaatttccttcatggtgtcatttagggcacttactgaacctcactgcagaatcactgaggaaaaaaagctctacacattagtttgatacagggtaaggccaggtgtttaaagaacgaaattccactttgattcataacaccaaggcctgatttgaatccagcaacagtggttaccctcacgttttacagcatggcaacccataacaccttgacacaaatggacccatgtatagacatgggttctgtggcctgggccagatttctcgggagattttcaggaatcacctgtcacgttgagtcgggccttacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatactacaactttgtgaggctaaggtcacctgtgatgtggctgttgcttcgagaggaagcagtaaatctttattggaattccagggatcctttgtgtgtccactgatgtttctatatggtagccaggaagacttgtgtgtgctgggctggtagtaatacaagaggtaaccccaggacagtttctccacaatgaagttgtgccaatagagctccagaaatatgtctctctcctctgacctttatttaaaaaagggacaacaagcgccttgacttctttccctttcctccttagggaagacattcttccaagtatcaagagagggagcccttgcttccctggaagacatttcgtcccagcaatcactctccagttccatgtgaccattcctactctgagccagttttggaaaggaaggtaagtggttggatttgattaggtgatatccaagtagaggtagccgaattctgtctaggactgggtcaatgatgaaaacccaatgtcatgaagaaaagtgatgacataaaattcatgctcaataggattacgctgaggcccaaccagggcgacagggttacaagaggtccattgactccttggggggctcttgggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgcaccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttcgctttcaattctcggccagtcggtccttttggaatttggggataacaaaatggtatgcaaaggtaccaaaggagctcgatttaggctatgttctccgatgtacatcccctggtttgtaacgatttaaggaatgtgttcaactccctataattgttttttcataattttgacctacttctcatggagagaggaggatgacattttttgaatattggcatctcatactttgatgcttacaattccatggcaaataactacaggaggacaacactggcctccagggccttatgggactcttcctttcccttgacaggggaggcccatgtgacagagcctttcttagggcaaaaaaaggattctatgatatccaaaaaggctgtcctccccaggatgggttcataaagggcaatcactctagcagatattccaaagatctcaccccagagacaatttacccatgtggaaagggtgagatattaatttttaccttggtgcccaccacattccaaatttccttcatggtatcatttggggcacttactgaacctcactgcagaatcactgaggaaaaaaagctctacacattagtttgatacagggtaaggccaggtgtttaaagaacctaattccactttgattcataacaccaagccctgacttgagtccaggaacagtggttactctcaagttttacagcagggcaacccataacaccttgacacaaatggacccatgtatagacatgggttctctggcctgggccaggattctcgggagattttcaggaatcacctgtcacgttgagtcgggccttacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatactacaactttgtgaggctaaggtcacatgtgatgtggctgttgcttcgagaggaagcagtaaatctttattggaattccagggatcctttgtgtgtccactgatgtttctatatggtagccaggaagacttgtgtgtgctgggctggtagtaatacaagaggtaaccccaggacagtttctccacaatgaagttgtgccaatagagctccagaaatatgtctctctcctctgacctttatttaaaaaagggacaacaagcgccttgacttctttccctttcctccttagggaagacattcttccaagtatcaagagagggagcccttgcttccctggaagacatttcgtcccagcaatcactctccagttccatgtgaccattcctactctgagccagttttggaaaggaaggtaagtggttggatttgattaggtgatatccaagtagaggtagccgaattctgtctaggactgggtcaatgatgaaaacccaatgtcatgaagaaaagtgatgacataaaattcatgctcaataggattacgctgaggcccaaccagggcgacagggttacaagaggtccattgactccttggggggctcttgggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgcaccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttcgctttcaattctcggccagtcggtccttttggaatttggggataacaaaatggtatgcaaaggtaccaaaggagctcgatttaggctatgttctccgatgtacatcccctggtttgtaacgttttaaggaatgtgttcaactccctataattgttttttcataattttgacctacttctcatggagagaggaggatgacattttttgaatattggcatctcatactttgatgcttacaattccatggcaaataactacaggaggacaacactggcctccagggccttatgggactcttcctttcccttgacaggggaggcccatgtgacagagcctttcgtagggcaaaaaaaggattctatgatatccaaaaaggctgtcctccccaggatgggttcataaagggcaatcactctagcagatattccaaagatctcaccccagagacaatttacccatgtggaaagggtgagatattaatttttaccttggtgcccaccacattccaaatttccttcatggtatcatttggggcacttactgaacctcactgcagaatcactgaggaaaaaaagctctacacattagtttgatacagggtaaggccaggtgtttaaagaacctaattccactttgattcataacaccaagccctgacttgagtccagcaacagtggttactctcaagttttacagcagggcaacccataacaccttgacacaaatggacccatgtatagacatgggttctctggcctgggccaggattctcgggagattttcaggaatcacctgtcacgttgagtcgggccttacaacatagaccttacagaggtctgatgccacatttgcactttgagcaaaaacacacagttactttaatcaccctcgaaatacctatctgtagttgttttattcaattatttttttgtcctatccatagaacttgagcagctcatcttgagtgttgatacctacaaaattgtgaggctaaggtcacaagggatgtggctgttgcttcgagaggaagcagtaaatctttattggaattccagggatcctttgcgtgccctctgatgtttctgtatggtagccaggaagacttgtgtgtgctgggctggtagtaatacaagaggtaaccccaggacagtttctgcacaatgaacttgtgccagtagagctccagaaaaatgtctctctcctctgacctttatttaaagaagggacaacaagcgccttgacttctttccctttcctccatagggaagacattcttccaagtatcaagaaagggagcccttgcttccatggaagatatttcctaccaacaatccctctccagttccatgtgaccattcctactctgagccagttttggaaaggaaggtaagttgttggattaggttaggtgatatccaagtagaggtagccgaattctgtctaggactgggtcaatgatgacaacccaatgtcatgaagaaagttgatgacataaaattcatgctcaataggattacactgagccccaaccagggcgacagagtcacaagaggtccgttgactccttggggggctcttgggtgacttccctgaagtcctcagatgctcttgccctgtttcccatgagaggaaatatggatatctagggtgcacattggttggcaaacactgcatgccaacaagcacctagtcccacaatggaaccttgggcatttctgcaaggatcgcaccttgctcatgacaatgtcttttctggtgttttgcaatcatctcacatgccaccttggaaggcagagaaacacagataatcaggtaagtggtcagaacatggtaaagcctccacatccaggtgacctcccccttcatgatttggctttcaattctcagccagtctgtccttttggaattagggataacaaaatggtatgcaacggtaccaaaggagcttgatagaggctatgttttccgaagtacatcccctggtttgtaacattttaaggaatgggttcaactcccgacaattgttttttcataattttgacctacttctcattgagagaggaggatgacattttttgaatattggcacctcatactttgatgcttacaattccattggaaatagcttcaggaggacaacacaggcctccagggccttatgggactcttcctttcccttgacaggggaggcccaagagacagagcgtttcttagggaaaaagaaggattctatgatatccaaaaaggctgtcctccccaggatgggttcacaaagggcaatccctctagcagttattccaaagatctcacctcagagacaatttacccatgtggaaagggtgaaatattcatttttaccttggtgcccaccacattccaaatttccttcatggtgtcatttagggcagttactgaacctcactgcaaaatcactgaagaaaaaaagctctacacattagtttgatacagggtaaggccaggtgtttaaagaacgaaattccactttgattcataacaccaaggcctgacttgagtccagcaacagtggttaccctcacgttttacagcatggcaacccataacaccttgacacaaatggacccatgtatagacatgggttctgtggcctgggccaggattctcgggagattttcaggaatcacctgtcaagttgagtcgggccttacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatactacaactttgtgaggctaaggtcacatgtgatgtggctgttgcttcgagaggaagcagtaaatctttattggaattccagggatcctttgtgtgtccactgatgtttctatatggtagccaggaagacttgtgtgtgctgggctggtagtaatacaagaggtaaccccaggacagtttctccacaatgaagttgtgccaatagagctccagaaatatgtctctctcctctgacctttatttaaaaaagggacaacaagcgccttgacttctttccctttcctccttagggaagacattcttccaagtatcaagagagggagcccttgcttccctggaagacatttcgtcccagcaatccctctccagttccatgtgaccattcctactctgagccagttttggaaaggaaggtaagtggttggatttgattaggtgatatccaagtagaggtagccgaattctgtctaggactgggtcaatgatgaaaacccaatgtcatgaagaaaagtgatgacataaaattcatgcttaataggattacgctgaggcccaaccagggcgacagggttacaagaggtccattgactccttggggggctcttgggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgcaccttgctcatgacaatgtcttttctgttgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaatttggggataacaaaatggtatgcaaaggtaccaaaggagctcgatttaggctatgttctccgatgtacatcccctggtttgtaacgttttaaggaatgtgttcaactccctataattgttttttcataattttgacctacttctcatggagagaggaggatgacattttttgaatattggcatctcatactttgatgcttacaattccatggcaaataactacaggaggacaacactggcctccagggccttatgggactcttcctttcccttgacaggggaggcccatgtgacagagcctttcttagggcaaaaaaaggattctttgatatccaaaaaggctgtcctccccaggatgggttcataaagggcaatccctctagcagatattccaaagatctcaccccagagacaatttacccatgtggaaagggtgagatattcatttttaccttggtgcccaccacattccaaatttccttcatggtatcatttggggcacttactgaacctcactgcagaatcactgaggaaaaaaacctctacacattaggttgatacggggtaaggccaggtgtttaaagaacctaattccactttgattcataacaccaagccctgacttgagtccagcaacagaggttactctcaagttttacagcagggcaacccataacaccttgacaaaaatggacccatgtatagacatgggttctctggcctgggccaggattctcgggagattttcaggaatcacctgtcacgttgagtcgggccttacaacatagaccttacagaggtctgatgccacatttgcactttgagcaaaaacacacagttactttaatcaccctcgaaatacctatctgtagttgttttattcaattatttttttgtcctatccatagaacttgagcagctcatcttgagtgttgatacctacaaaattgtgaggctaaggtcacaagggatgtggctgttgcttcgagaggaagcagtaaatctttattggaattccagggatcctttgcgtgccctctgatgtttctgtatggtagccaggaagacttgtgtgtgctgggctggtagtaatacaagaggtaaccccaggacagtttctgcacaatgaacttgtgccagtagagctccagaaaaatgtctctctcctctgacctttatttaaagaagggacaacaagcgccttgacttctttccctttcctccttagggaagacattcttccaagtatcaagaaagggagctcttgcttccatggaagatatttcctcccaacaatccctctccagttccatgtgaccattcctactctgagccagttctggaaaggaaggtaagtggttggattaggttaggtgatatccaagtagaggtagccgaattctgtctaggactgggtcaatgatgacaacccaatgtcatgaagaaagttgatgacataaaattcatgctcaataggattacgctgaggcccaaccagggcgacagagtcacaagaggtccgttgactccttggggggctcttgggtgacttccctgaagtcctcagatgctcttgccctgtttcccatgagaggaaatatagatatctagggtgcacattggttggcaaacactgcatgccaacaagcacctagtcccacaatggaaccttgggcatttctgcaaggatcgcaccttgctcatgacaatgtcttttctggtgttttgcaatcatctcacatgccaccttggaaggcagagaaacacagataatcaggtaagtggtcagaacatggtaaagcctccacatccaggtgacttcccccttcatgatttggctttcaattctcagccagtctgtccttttggaattagggataacaaaatggtatgcaacggtaccaaaggagcttgatagaggctatgttttccgaagtacatcccctggtttgtaacattttaaggaatgggttcaactcccgacaattgttttttcataattttgacctacttctcattgagagaggaggatgacattttttgaatattggcacctcatactttgatgcttacaattccattggaaatagcttcaggaggacaacacaggcctccagagccttatgggactcttcctttcccttgacaggggaggcccaagtgatagagcctttcttagggaaaaaaaaggattctatgatatccaaaaaggctgtcctccccaggatgggttcacaaagggcaatccctctagaagttattccaaaaatctcacctcagagacaatttacccatgtggaaagggtgaaatattcatttttaccttggtgcccaccacattccaaatttccttcatggtgtcatttagggcaattactgaacctcactgcaaaatcactgaagaaaaaaagctctacacattagtttgatacagggtaaggccaggtgtttaaagaacgaaattccactttgattcataacaccaaggcctgacttgagtccagcaacagtggttaccctcacgttttacagcatggcaacccataacaccttgacacaaatggacccatgtatagacatgggttctgtggcctgggccaggattctcgggagattttcaggaatcacctgtcaagttgagtcgggccttacaacatagaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatactacaaaattgtgaggctaaagtcacatgtgatgtggctgttgtttcgagaggaagcagtaaatctttattggaattccagggatcctttgtgtgtccactgatgtttctatatggtagccaggaagacttgtgtgtgctgggctggtagtaatacaagaggtaaccccaggacagtttctccacaatgaagttgtgccaatagagctccagaaatatgtctctctcctctgacctttatttaaaaaagggacaacaagcgccttgacttctttccctttcctccttagggaagacattcttccaagtatcaagaaagggagcccttgcttccctggaagacatttcgtcccagcaatcactctccaggtccatgtgaccattcctactctgagccagttttggaaaggaaggtaagtggttggatttgattaggtgatatccaagtagaggtagccgaattctgtctaggactgggtcaatgatgaaaacccaatgtcatgaagaaaagtgatgacataaaattcatgctcaataggattacgctgaggcccaaccagggcgacagggttacaagaggtccattgactccttggggggctcttgggtgacttccctgaagtcctcagatgcccttgccctgtttcccatgagaggaaatgtggacatctagggtgcacattggttggcaaacactgcatgccaacaagcacctagtcccccaatggaaccttgggcatttctgcaaggatcgcaccttgctcatgacaatgtcttttctgttgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaatttggggataacaaaatggtatgcaaaggtaccaaaggagctcgatttaggctatgttctccgatgtacatcccctggtttgtaacgttttaaggaatgtgttcaactccctataattgttttttcataattttgacctacttctcatggagagaggaggatgacattttttgaatattggcatctcatactttgatgcttacaattccatggcaaataactacaggaggacaacactggcctccagggccttatgggactcttcctttcccttgacaggggaggcccatgtgacagagcctttcttagggcaaaaaaaggattctatgatatccaaaaaggctgtcctccccaggatgggttcataaagggcaatccctctagcagatgttccaaagatctcaccccagagacaatttacccatgtggaaagggtgagatattaatttttacattggtgcccaccacattccaaatttccttcatggtatcatttggggcacttactgaacctcactgcagaatcactgaggaaaaaaagctctacacattaggttgatacggggtaaggccaggtgtttaaagaacctaattccactttgattcataacaccaagccctgacttgagtccagcaacagtggttactctcaagttttacagcagggcaacccataacaccttgacacaaatggacccatgtatagacatgggttctctggcctgggccaggattctcgggagattttcaggaatcacctgtcacgttgagtcgggccttacaacatagaccttacagaggtctgatgccacatttgcactttgagcaaaaacacacagttactttaatcaccctcgaaatacctatctgtagtggttttattcaattattttttgtcctatccatagaacttgagcagctcatcttgagtgttgatacctacaaaattgtgaggctaaggtcactagggatgtggctgttgcttcgagaggaagcagtaaatctttattggaattccagggatcctttgcgtgccctctgatgtttctgtatggtagccaggaagacttgagtgtgctgggctggtagtaatacaagaggtaaccccaggacagtttctccacaatgaagttgtgccaatagagctccagaaaaatgtctctctcctctgacctttatttaaagaagggacaacaagcgccttgacttctttccctttcctccttagggaagacattcttccaagtatcaagaaagggagctcttgcttccatggaagatatttcctcccaacaatccctctccagttccatgtgaccattcctactctgagccagttctggaaaggaaggtaagtggttggattaggttaggtgatatccaagtagaggtagccaaattctgtctaggactgggtcaatgatgacaacccaatgtcatgaagaaagttgatgacataaaattcatgctcaataggattacgctgaggcccaaccagggcgacagagtcacaagaggtccgttgactccttggggggctcttgggtgacttccctgaagtcctcagatgctcttgccctgtttcccatgagaggaaatatggatatctagggtgcacattggttggcaaacactgcatgccaacaagcacctagtcccacaatggaaccttgggcatttctgcaaggatcgcaccttgctcatgacaatgtcttttctggtgttttgcagtcatctcacatgccaccttggaaggcagagaaacacagataatcaggtaagtggtcagaacatggtaaagcctccacatccaggtgacctcccccttcatgatttggctttcaattctcagccagtcggtccttttggaatttggggataacaaaatggtatgcaaagataccaaaggagctcgatttaggctatgttctccgatgtacatcccctggtttgtaacgttttaaggaatgtgttcaactccctataattgttttttcataattttgacctacttctcatggagagaggaggatgacattttttgaatattggcatctcatactttgatgcttacaattccatggcaaataactacaggaggacaacactggcctccagggccttatgggactcttcctttcccttgacaggggaggcccatgtgacagagcctttcttagggcaaaaaaaggattctatgatatccaaaaaggctgtcctccccaggatgggttcataaagggaaatccctctagcagatgttccaaagatctcaccccagagacaatttacccatgtggaaagggtgagatattaatttttacattggtgcccaccacattccaaatttccttcatggtatcatttggggcacttactgaacctcactgcagaatcactgaggaaaaaaagctctacacattaggttgatacggggtaaggccaggtgtttaaagaacctaattccactttgattcataacaccaagccctgacttgagtccagcaacagtggttactctcaagttttacagcagggcaacccataacaccttgacacaaatggacccatgtatagacatgggttctctggcctgggccaggattctcgggagattttcaggaatcacctgtcacgttgagtcgggccttacaacatagaccttacagaggtctgatgccacatttgcactttgagcaaaaacacacagttactttaatcaccctcgaaatacctatctgtagtggttttattcaattattttttgtcctatccatagaacttgagcagctcatcttgagtgttgatacctacaaaattgtgaggctaaggtcactagggatgtggctgttgcttcgagaggaagcagtaaatctttattggaattccagggatcctttgcgtgccctctgatgtttctgtatggtagccaggaagacttgagtgtgctgggctggtagtaatacaagaggtaaccccaggacagtttctccacaatgaagttgtgccaatagagctccagaaaaatgtctctctcctctgacctttatttaaagaagggacaacaagcgccttgacttctttccctttcctccttagggaagacattcttccaagtatcaagaaagggagctcttgcttccatggaagatatttcctcccaacaatccctctccagttccatgtgaccattcctactctgagccagttctggaaaggaaggtaagtggttggattaggttaggtgatatccaagtagaggtagccaaattctgtctaggactgggtcaatgatgacaacccaatgtcatgaagaaagttgatgacataaaattcatgctcaataggattacgctgaggcccaaccagggcgacagagtcacaagaggtccgttgactccttggggggctcttgggtgacttccctgaagtcctcagatgctcttgccctgtttcccatgagaggaaatatggatatctagggtgcacattggttggcaaacactgcatgccaacaagcacctagtcccacaatggaaccttgggcatttctgcaaggatcgcaccttgctcatgacaatgtcttttctggtgttttgcaatcatctcacatgccaccttggaaggcagagaaacacagataatcaggtaagtggtcagaacatggtaaagcctccacatccaggtgacctcccccttcatgatttggctttcaattctcagccagtctgtccttttggaattagggataacaaaatggtatgcaacggtaccaaaggagcttgatagaggctatgttttccgaagtacatcccctggtttgtaacattttaaggaatgggttcaactcccgacaattgttttttcataattttgacctacttctcattgagagaggaggatgacattttttgaatattggcacctcatactttgatgcttacaattccattggaaatagcttcaggaggacaacacaggcctccagagccttatgggactcttcctttcccttgacaggggaggcccaagagacagagcatttcttagggaaaaagaaggattctatgatatccaaaaaggctgtcctccccaggatgggttcacaaagggcactccctctagcagttattccaaaaatctcacctcagagacaatttacccatgtggaaagggtgaaatattcatttttaccttggtgcccaccacattccaaatttccttcatggtgtcatttagggcaattactgaacctcactgcaaaatcactgaagaaaaaaagctctacacattagtttgatacagggtaaggccaggtgtttaaagaacgaaattccactttgattcataacaccaaggcctgacttgagtccagcaacagtggttaccctcacgttttacagcatggcaacccataacaccttgacacaaatggacccatgtatagacatgggttctgtggcctgggccaggattctcgggagattttcaggaatcacctgtcaagttgagtcgggccttacaacatacaccttacagaggtctgatgccacatttgcactttgagcaaaaacacacagttactttaatcaccctcgaaatacctatctgtagttgttttattcaattatttttttgtcctatccatagaacttgggcagctcaacttgagtgttgatactacaaaattgtgaggctaaggtcacatgtgatgtggctgttgcttcgagaggaagcagtaaatctttattggaattccagggttcctttgtgtgtccactgatgtttctatatggtagccaggaaaacttgtgtgtgctgggctgatagtaatacaagaggtaaccccaggacagtttctccacaatgaagttgtgccaatagagctccagaaaaatgtctctcttctctggcctttacttaaagaagggataacaagcgccttgacttctttccctttcctccttagggaagacattcttccaagtatcaagaaagggagcccttgcttccctggaagacatttcgtcccagcaatcactctccagttccatgtgatcattcctactctgagccagttttggaaaggaaggtaagtggttggatttgattaggtgatatccaagtagaggtagccgaattctgtctaggactgggtcaatgatgaaaacccaatgtcatgaagaaaagtgatgacataaaattcatgctcaataggattacgctgaggcccaaccagggcgacagggttacaagaggtccattgactccttggggggctcttgggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgcaccttgctcatgacaatgtcttttctggtgttttgcagtcatctcacatgcccccttggaaggcagagaaacacagataatcaggtaagtggtcagaacatggtaaagcctccacatccaggtgacctcccccttcatgatttggctttcaattctcagccagtcggtccttttggaatttggggataacaaaatggtatgcaaaggtatcaaaggagctctatttaggctatgttctccgatgtacatcccctggtttgaaacggtttaaggaatgtgttcaactcccgacaattgttttttcataattttgacctacttctcatggagagaggaggatgacattttttgaatattggcatctcatactttgatgcttacatttccatggcaaatagctacaggaggacaacacaggcctccaggctcttatgggatcttcctttcccttgacagggtttgcacaagtgacttagcctttcttagggaaaaagaaggattctatgatatccaaaaaggctgtcctccccagaatgggttcacaaagggcaattcctctagcagatattccaaagatctcaccccagagacaatttacccatgtggatagggtgagataatcatttttaccttggtgcccaccacattcatatttttttcatggtatcatttagggcacttactgaacctcactgcagaatcactgaggaaaaaaagctctacacattaggttgatacagggtaacaccaggtgtttaaagaacctaattccactttgattcataacaccaaggcctgactttagtccagtaagagtgcttacactcacgttttacagcagggcaacccataacacgttgacaaaaatggatacatgtatagacatgggttccgtggcctcggtccaggattctcgggagattttcaggaatcacctttcactttgagtcaggtcgtacaacatagaccttacagaggtctgatgccacatttgcactttgagcaaaaacacacagttactttaatcaccctcgaaatacctatctgtagttattttattcaattatttttttgtcctatccatagaactagggcagctaaacttgagtgttgatacctacaaaattgtgaggctaaggtcacatgtgatgtggctgttgcttcgagaggaagcagtaaatctttatttgaatgccagggatcctttgtgtgtccactgatgtttctgtatggtagccaggaagacttgtgtgtgctgtgatggtaataatacaagaggtaaccccaggacagtttctccacaatgaagttgtgccaatagagctccagaaaaatgtctctctcctctgacctttatttaaagaagggacaacaagcgccttgacttctttccctttcctccttagggaagacattcttcaaagtatcaagaaagggagcccttgcttccctggaagacatttcatcccagcaatccctctccagttccatgtgaccattcctattctgagccagttttggaaaggaaggtaagtggttggattaggttaggtgatatccaagtagaggtagccgaattctgtctaggactgggtcaatgatgacaacccaatgtcatgaagaaatgtgatgacataaaattcattctcaataggattacactgaggcccaaccagggcgacagggttacaagaggtccattgactccttggggggctcttgggtgacttccctgcagtcctcagatgcccttgccctgtttcccatgagaggaaatgtggacatctagggtgcacattggttggcaaacactgcatgccaacaagcacctagtcccacaatggaaccttgggcatttctgcaaggatcgcaccttgctcatgacaatgtcttttctggtattttgcagtcatctcacatgccaccttggaaggcagagcaacacagataatcaggtaagtggtcagaacatggtaaagcctccacatccaggtgacctcccccttcattatttggctttcaattctcagccagtctgtccttttggaattagggataacaaaatggtatgcaacggtaccaaaggagctctatttaggctatgttctccgatgtacatcccctggtttgttagggtttaaggaatatgttcaactcctgacaatagttttttcataattttgacctacttctcatggagagaggaggatgacattttttgaatattggcatctcatactttgatgcttacaattccattggaaatagctacaggaggacaacacaggcctccagggccttatgggactcttcctttcccttgacaggggaggcccaagtgacagagcttttcttagggaaaaaaaaggattctatgatatccaaaaaggctgtactccccaggatgggttcacaaagggcaattcctctagcagatattccaaagatctcaccccagagaaaatttacccatgtggatagggtgagatattcatttttaccttggtgcccaccacattctaaatttccttcatggtatcatttaggggaattactgaacctcactgcagaatcactgaggagaaaaagctctacacattaggttgatagagggtaaggccaggtatttaaagaacctaattccactttgattcataacaccaagccctgacttgagtccagcaacagtgggtaccgtcacgttttaaacagggcaacccataacacctcgacacaaatggatccatgtttagacatgggttctgtggcctgggcccaggattctcggtagattttcaggaatcaactttcatgttgagtcgggtcttacaacatagaccttacagaggtctgatgtcacatttgcactttgagcaaaaacatacagttactttaatcaccctggaaatacctatctgtagttgttttattcaattatttttttgtcctatccatagaacttgggcagctcaacttgagtgttgatacctacaaaattgtgaggctaaggtcacatgtgatgtggctgttgcttcgagaggaagcagtaaatctttattggaatgccagggatcctttgtgtgtccactgatgtttctgtatggtagccaggaagacttgtgtgtgctgggctggtagtaatacaagaggtaaccccaggacagtttcaccataatgaagttgtgccaatagagctccagaaaaatgtctctctcctctgacctttatttaaagaagggacaacaagcgccttgacttctttccctttccgccttagggaagacattcttccaagtatcaagaaagggagcccttgcttccctggaagacatttcgtcccagcaatcactctccagttccatgtgaccattcctactctgagccagttctggaaaggaaggtaagtggttggtaggttaggtgatatccaagtagaggtagccgaattcggtctaggactgggtcaatgatgacaacccaatgtcatgaagaaaagtgatgacagaaaatccatgctcaataggattacgctgaggcccaaccagggcgacagggtcacaagaggtccgttgactccttggggggctctgggtgacttccctgaagtcctcagatgcccttgccctgtttcccatgagaggaaatgtggacatctagggtgcacattggttggcaaacactgcatgccaataagcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagtctccacatccaggtgacctcccccttcatgatttagctttcatttctcagccagtctgtccttttggaatttggggataacaaaatggtatgcaaaggtaccaaaggagctcgatttaggctatgttctctgatgtacatcccctggtttgtaacattttaaggaatgtgttcaacacccgataattgttttttcataattttgacctacttctcattgagagaggagcatgacattttttgaatcttaggatctcatactttgatgcttacaattttatgtcaaatagctacagtaggacaacacaggcctccagggccttatgggatcttcctttcccttgacaggggaggcccaagtgactgatcctttcttagggaaaaagaaggattctatgatatacaaaaaggctgtcctccccaggatgggttcacaaagggcaatccctctagcagatattccaaagatctcaccccagagacaatttaccaatgtggatatggtgagatattcatttttaccttagtgcccaccacattcaaatttccttcatggtatcatttagggcacttactgaacctcactgcagaatcactgaggaaaaaaagctctacacattaggttgatacaggttaaggccaggtgtttaaagaacctaattccactttgattcataacaccaaggcctgacttgagtccagcaacagtggttaccctcacgttttacagcaggacaacccataacaccttgacaaaaatggatccatgtatagacatgggttctgtggcctgggcccaggattctcgggagattttcaggaatcacctttcgcgttgagtcgggtctttcaacatagaacttacagaggtctgatgctacatttgcactttgagcaaaaacacagttactttaatcaccctcgaaatacctatctgtagttgttttattcaattatttatttgttctatccatagaacttgggcagctcaacttgagtgttgatacctacaaaattgtgaggctaagttcacatgtgatgtggctgttgctttgagagcaagcagtaaatctttattagaatgccattgttcctttgtgtgtccactgatgtttctctatggtagccaggaagacttgtgtgtgctgggctggtagtagtacaagaggtaaccccaggacagtttctgcacaatgaagttgtgccagtagagctccagaaaaatgtctctctcctctgacctttatttaaagaagggacaacaagcgccttgacttctttccctttcctccttagggaagacattcttcaaagtatcaagaaagggagcccttgcttccctggaagacatttcgtcccagcaatcaatctccagttccatgtgaccattcctactctgtgccagttttggaaaggaaggtaagtggttggattaggttaggtgatatccaagtagaggtagccgaattctgtctaggactgggtcaatgatgacaacccaatgtcatgaagaaaggtgatgacataaaattcatgctcaataggattacgctgaggcccaaccaggacgacaggtttacaagaggtccattgacttcttggggggctcttgggtgacttccctgaagtccgcagataaccttgcctgtttcccatgagaggaaatgtggacatctagggtgcacattggttggcaaacactgcatgccaacaagcacctagtcccacaatggaaccttgggcatttctgcaaggatcgcaccttgctcatgacaatgtcttttctgctgttttacagtcatctcacatgccaccttgaaaggcagagaaacacagataatcaggtaggtggtcagaacatggtaaagcctccacatccaggtgacatccccgtcatgatttggttttcaattctcagccagtctgtccttttagaattagggataacaaaatggtatgcaatggtaccaaaggagctctatttaggctatgttctccgatgtacatcccctggtttgtaatggtttaaggaatgtgttcaactcccgacaattgttttttcataattttgacctacttctcatggagagaggaggatgacattttttgaatattggcatctcatactttgatgcttacaattccattggaaaaagctacaggaggacaacacaggcctccagggacttatgggactcttcctttcccttgacaggggaggcccaagtgacagagcctttcttagggaaaaaaaggattctatgatatccaaaaaggctgtactccccaggatgggttcacaaagggcaattcctcgagcagatattacaaagatctcaccccagagaaaatttacccatgtggatagggtgagatattcatttttaccttggtgcccaccacattctaaatttccttcatggtatcatttagggcacttactgaacctcactgcagaatcactgaggaaaaaaagctctacacatagggtgatacagggtaaggccaggtgtttaaagaacctaattccactttgattcataacaccaaggcctgacttgagtccagcaacagtggttaccctcacgttttacagcagggcaacccataacaccttgacacaaatggatgcatgtatagacatgggttctgtggcctgggcccaggattctcgggagattttcagtaatcacctttcactttgagtcgggtcgtacaacatagacattacagaggtctgatgccacatttacactttgagtaaaaacacacagttactttaatcaccctcgaaatacctatctgtagttgttttattcaatttttttgtcctatccatagaacttgggcagctcaacttgagtgttgatacctacaaaattgtgaggctaaggtcacctgtgatgtggctgttgcttcgagaggaaacagtaaatctttattggaatccagggttcttttgtgtgtccactgatgtttctctatggtagccaggaagacttgtgtgtgctggactggtagtaatacaagaggtaaccccaggacagtttctgcacaatgaagttgtgccagtatagctccagaaaaatgtctctctcctctgacctttatttaaagaagggacaacaagcgccttgacttctttccctttcctccttagggaagacattcttccaagtatcaagaaagggagcccttgcttcactggaggacatttcctcccagcaatccctctccagttccatgtgaccattcctactctgagccagttctggaaaggaaggtaagtggttggattaggttaggtgatatccaagtagaggtagccgaattctgtctaggactgggtcaatgatgacatcccaatgtcatgaagaaaggtgatgacataaaattcatgctcaataggattacgctgaggcccaaccagggcgacagggttacaagaggtccattgactccttggggggctcttgggtgacttccctgaagtcctcagatgcccttgccctgtttcccatgagaggaaatgtggacatctagggtgcacattggttggcaaacactgcatgccaacaagcacctagtcccacaatggaacctagggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacatccccttcatgatttggctttcaattctcagccagtcggtccttttggaatttgggataacaaaatggtatgcaacggtaccaaaggagctctatttaggctataatctccgatgtacatccccaggtttgtaacggtttaaggaatgtgttcaactcccgacaatagttttttcataattttgacctacttctcatggagagaggaggatgacattttttgaatattggcatctcatactttgatgcttacaattccattggaaaaagctacaggaggacaacacaggcctccagggccttatgggactcttcctttcccttgacaggggaggcccaagtgacagagcctttcttagggaaaaaaaggattctatgatatccaaaaaggctgtactccccaggatgggttcacaaagggcaattcctcgagcagatattacaaagatctcaccccagagaaaatttacccatgtggatagggtgagatattcatatttaccttggtgcccaccacattccaaatttccttcatggtatcatttagggcacttactgaacctcactgcagaatcactgaggaaaaaaagctctacacattaggttgatacagggtaaggccaggtgtttaaagaacctaattccactttgattcataacaccaaggcctgacttgagtccagcaacagtggttaccctcacgttttacagcagggcaacccataacaccttgacacaaatggatgcatgtatagacatgggttctgtggcctgggcccaggattctcgggagattttcagtaatcacctttcactttgagtcgggtcgtacaacatagacattacagaggtctgatgccacatttacactttgagtaaaaacacacagttactttaatcaccctcgaaatacctatctgtagttgttttattcaatttttttgtcctatccatagaacttgggcagctcaacttgagtgttgatacctacaaaattgtgaggctaaggtcacctgtgatgtagctgttgcttcgagaggaaacagtaaatctttattggaatccagggttcctttgtgtatccactgatgtttctctatggtagccaggaagaattgtgtgtgctgggctggtagtaatacaagaggtaaccccaggacagtttctgcacaatgaagttgtgccagtatagctccagaaaaatgtctctctcctctgacctttatttaaaaaagggacaacaagcgccttgacttctttccctttcctccttagggaagacattcttccaagtatcaagaaagggagcccttgcttccctggaggacatttcctcccagcaatccctctccagttccatgtgaccattcctactctgagccagttctggaaaggaaggtaagtggttggattaggttaggtgatatccaagtagaggtagccgaattctgtctaggactgggtcaatgatgacaacccaatgtcatgaagaaaggtgatgacataaaattcatgctcaataggattacgctgaggcccaaccagggcgacagggttacaagaggtccattgactccttggggggctcttgggtgacttccctgaagtcctcagatgcccttgccctgtttcccatgagaggaaatgtggacatctagggtgcacattggttggcaaacactgcatgccaacaagcacctagtcccacaatggaaccttgggcatttctgcaaggatcgcaccttgctcatgacaatgtcttttctggtgttttgcagtcatctcacatgccaccttggaaggcagagaaacacagataatcaggtaagtggtcagaacatggtaaagcctccacatccaggtgacatccccttcatgatttggctttcaattctcagccagtctgtccttttggaatttgggataacaaaatggtatgcaacggtaccaaaggagatctatttaggctatgttctccgatgtacatccccaggtttgtaacggtttaaggaatgtgttcaactcccgacaattgttttttcataattttgacctacttctcatggagagaggaggatgacattttttgaatattggcatctcatactttgatgcttacaattccattggaaaaagctacaggaggacaacacaggcctccagggccttatgggactcttactttcccttgagaggggaggcccaagtgacagagcctttcttagggaaaaaaaaggattctatgatatccaaaaaggctgtactccccaggatgggttcacaaagggcaattcctctagcagatattccaaagatctcaccccagagaaaatttacccatgtggatagggtgagatattcatttttaacttggtgcccaccacattccaaatttccttcatggtatcatttagggcacttactgaacctcactgcagaatcaatgaggaaaaaaagctctacacattaggttgatacagggtaaggccaggtgtttaaagaacctaattccacattgattcataacaccaaggcctgacttgagtccagcaacagtggttaccctcacgttttacagcagggcaacccataacaccttgacacaaatggatgcatatatagacatgggttctgtggcctgggcccaggattctcgggagattttcagtaatcacctttcacgttgagtcgggtcgtacaacatagacattacagaggtctgatgccacatttacactttgagtaaaaacacacagttactttaatcaccctcgaaatacctatctgtagttgttttattcaatttttttgtcctatccatagaacttgggcagctcaacttgagtgttgatacctacaaaattgtgaggctaaggtcacctgtgatgtggctgttgcttcgagaggaaacagtaaatctttattggaatccagggttcctttgtgtatccactgatgtttctctatggtagccaggaagacttgtgtgtgctgggctggtagtaatacaagaggtaaccccaggacagtttctgcacaatgaagttgtgccagtatagctccagaaaaatgtctctctcctctgacctttatttaaagaagggacaacaagcgccttgacttctttccctttcctccttagggaagacattcttccaagtatcaagaaagggagcccttgcttccctggaggacatttcctcccagcaatccctctccagttccatgtgaccattcctactctgagccagttctggaaaggaaggtaagtggttggattaggttaggtgatatccaagtagaggtagccgaattctgtctaggactgggtcaatgatgacaacccaatgtcatgaagaaaggtgatgacataaaattcatgctcaataggattacgctgaggcccaaaaagggcgacagggttacaagaggtccattgactccttggggggctcttgggtgacttccctgaagtcctcagatgcccttgccctgtttcccatgagaggaaatgtggacatctagggtgcacattggttggcaaacactgcatgccaacaagcacctagtcccactatggaaccttgggcatttctgcaaggatcgcaccttgctcatgacaatgtcttttctggtgttttgcagtcatctcacatgccaccttggaaggcagagaaagacagataatcaggtaagtggtcagaacatggtaaagcctccacatccaggtgacatccccttcatgatttggctttcaattctcagccagtctgtcctttttgaatatggggataacaaaatggtatgcaacagtaccaaaggagcttgatttaggctatgttctcccatgcagatcccctagtttgtaaagttttaaggaatgtgttctaatcccgaaaattgttttttcataattttgacctacttctcatggatagaggaggatgacatttttgaactcattcggttgatacagggtaaggccatgtgtttaaagaacctaattccactttcattcataacaccaaggcctgatttgagtccagcaacagtggttaccctcacgttttacagcagggcaacccataacaccttgacacaaatggatacatgtatagagatgggtttgtggcctgggcccaggattctcgggagattttcaggaatcacctttcacattgagtcgggtcttacaacatagaccttacagaggtctgatgccacatttgcactttgagcaaaaacacacagttactttaatcaccctcgaaatacctatctgtagtttttttattcaattatttttttgtcctatccatagaacttgggcagctcaacttgagtgttgatacctacaaaattgtgaggctaaggtaacatgtgatgtggctgttgcttcgagaggaagcagtacatctttattggaatgccagggttcctttctgtgtccactgatgtttctctgtggtagccaggaagacttgtgtgtgctgggctggtagtattacaagaggtaaccccaggacagtttctgcacaatgaagttgtcccagtagagctccagaaaaatgtctctctcctcagatctttatttaaagaagggacaacaagcgccttgacttctttccctttcctccttagggaagacattcttccaagtatcaagaaagggagcccttgcttccctggaagatatattctcccagcaatcctcctccagttccatgtgaccattcctactctgagccagttttggaaaagaaggtaagtagttggattaggttacgtgatatccaagtagaggtagccgaattctgtctaggactgggtcaatgatgacaacccaatgtcatgaagaagggtgatgacataaaattcatgctcaataggattacgctgaggcccaaccagggcgacagggtcacaagaggtcagttgactcctttgggggccttatggtacacttcctttcccttgagaggggaggcccaagtgacagatcctttcttaggtaaaaagaaggattctatgatatccaaaaaggctgtcctccccaggatgggttcacaaagggcaatccctctagcagatattccaaagatctcaccctagagacaatttacccatgtggaaagggtgagatattcatttttaccttggtgcccaccacattccaaatttccttcatggtatcatttagggcacttactgaacctcactgcagaatcactgaggaaaaaaagctctacacattaggttgatacagggtaaggccaggtgtttaaagaacctaattccactttgattcataacaccaaggcctgacttgagtccagcaacagtggttaccttcatgttttacagcagggcaacccataacaccttgacacaaatggatccatgtatagacatgggttctgtggtctgggcccaggattctccggagaatttcaggaatcacctttcactttgagtcgggtcgtacaacatagaccttacagaggtctgatgccacatttgcactttgagcaaaaacacagttactttaatcaccctccgaatacctatctgttgttgttttattcaattatttttttctcctatccatagaacttgggcagctcaacatgagttttgatacctacaaaattgtgaggctaaggttacatgtgatgtggctgttgcttcgagaggaagcagtaaatctttattggaatgccagggttcctttctgtgtccactgatgtttctctatggtagccaggaagacttgtgtatgctgggctggtagtaatacaagaggtaactccaggacagtttctgcataatgaagttgtgccagtagagctccagaaaaatgtctctctcctctgacctttatttaaagaagggacaacaagggccttgacttctttccctttcctccttagggaagacattcttccaagtatcatgaaagggagcccttgcttctctggaagacatttcctcccagcaatccctctccagttccatgtgaccattcctactctgagccagttttggaaaggaaggtaagtggttggattaggttaggtgatatccaagtagaggtagccaaattctgtctaggactgggtcaatgatgacaacccaatgtcatgaagaaaggtgatgacataaaattcatgctcaataggattacgctgaggcccaaccagggtgacagggtcacaagaggtccgttgactccatggggggctcttgggtgacttcaatgaagtcctcagatgccctttccctgtttcccatgagaggaaatgtggacatctagggtgcacattggttggcaaacactgcatgccaacaagcacctagtcccacaatggaaccttgggcagttctgccagtattgtcccttgcgcatgacagtgtcttttctggtgttttgcagtcatctcacatgccaacttggaaggcagagaaacacagataatcaggtatgtggtcaggacatggtaaagcctccacatccaggtgacctcccccttcatgtattggctttcaattctcagccagtttgtccttttggaatatggagataacaaaatggtatgcaacggtaccaaaggagctcgatttaggctatgttctcccatgcagatcccctggtttgtaaagttttaaggaatgtgttctactcccgataattgttttttcataattttgacctacttctcaaggagagaggaggatgacattttttgaatgttgggatctcatatttgatgcttaaaattccatgacaaatagctacaggaggacaaaataggcctccagggccttatgggctcttcttttcccttgacaggggaggctcaagtgacagagattttcttagggaaaaagaaggattctatgatatccaaaaagactgtcctccccaagatgggttcacaaagggcaatccctctagaagatattccaaagatctcaccccagagacaatttacccatgtggaaagggtgagataatcatttttgcctaagtgcccaccacattcatatttccttcatggtatcatttagggcacttactgaacctcactgcagaatcaatgaggaaaaaaacctctacacaataggctgatacagggtaaggccaggtgtttaaagaacctaattccactttgattcataacaccaaggcctgacttgagtccagcaacagtggttaccctcacgttttacagcagggcaacccataacaccttgacacaaatggatgcatgtatagacatgggttctgtggactgagaccaggattctctggagattttcaggaagcacctttcacgttttgtctggtcatacaacatagaccttacagatgtctgattccacatttgcactttgagcaaaaacacacagttactttaatcaccctcgaaatacctatctgtagttgatttattcaattatttttttgtcctatccatagaacttgggcaactcaacttgagtgttgatacctacaaaattgtgaggctaaggtcacatgtgatgtggctgttgcctcaagaggaagcagtaaatctttattggaatccagggttcctttgtgtgtccactgatgtttctctatggtagccaggaagacttgtgtgtgctgggctggtagtaatacaagaggtaaccccaggacagtttctgcacaatgaagttgtgccagtagagctccagaaaaatgtctctctcctctgacctttatttaaagaagggacaacaagggccttgacttctttccctttcctccttagggaagacattcttccaagtatcatgaaagggagcccttgcttccctggaagacatttcgtccgagcaatccctctccaggtccatgtgaccattcctactctgagccagttttggaaagaaaggtaagtagttggattaggttaggtgatatccaagtagaggtagccgaattctatctaggactgggtcactgatgacaacacaatgtcatgaagaaaggtgatgacataaaattcatgctcaataggattactttgaagcccaaccagggtcacagggtcagaagaggtccattgactctttggggggctcttgggtgacttcaatgaagtcctcagatgcccttgccctgtttcccatgagaggaaatgtggacatctagggtgcacattggttggcaaacactgcatgccaacaagcacctagtcccacaatggaaccttgggcatttctgcaaggattgtcctttgcgcatgacagtgtcttttcttgtgttttggagtcatctcacatgccaccttggaaggcagagacacagataatcaggtaagtggtcagaacatggtaaagcctccacatccaggtgacctcacccttcatgtattggctttcaattctcagccagtctgtccttttggaatatggggataacaaaatggtatgcaactgtatccaaaggagctcgatttaggctatgttctcccatgcagatcccctggattgtaacgttttaaggaatgtgttcaacgcccgataattgttttttcataattttaacctacttctcatggagagtggagaatgacattttttgaatgttgggatctcatactttgatgcttacaattccatggcaaatagctacaggaggacaacacaggccttcagggccttatgggactcttcctttcctttgacagggaggcccaaatgacagagccgtcttagggaaaaagaaggattctatgatatccaaaaaggctgtcctccccaggatgggttcacaaagggcaatcactctagtagatattccaacgatctcaccccagagacaatttacccatgtggatagggtgagatattcatttttaccttggtgcagaccacattccaaatttccttcattttatcatttagggcacttactgaacctcactgcacaatcactgaggaaaaaaagctctacacaataggttgatacagggtaaggccaggtgtttagagaacctaattccactttgattcataacaccaaggtctgacttgagtacagcaacagtggttaccctcacgttttacagcagggcaacccataacacctttacacaaatggttccatgtatagacattggttctgtggcctgggcccaggattttcgggagattttcaggaatcacctttcacattgagtcgagtcgtacaacatagaccttacagaggtctgatgccacatttgcactttgagcaaaaacacacagttactttaatcaccctcgaaatacctatctgtacttgtttcattcaattatttttttgtcctatccatagaattttggcagctcaacttgagtgttgatacctacaaaattttgagtctaaggtcacatgtcatgtggctgttgctttgagaggaaccaggaaatctttattggaatgccagggttcctttttgtgtccactgatgtttgtctatggtagccaggaagacttgtgtgtgctgggctggtagtaatacaagaggtaaaccccggacagtttctgcacaatgaagttgtgcctgtagagctccagaaaaatgtctctctcctctgacctttatttaacgaagggacaacaagcgccttgacttctttccctttcctctttagggaagacattcttccaagtatcaagaaagtgagcccttgcttccctagaagacatttcgttccagcaatccctctccagttccatgtgaccattcctactctgagccagtattggaaagaaaggtaattggttggattaggttaggtgatatccaagtagaggtagccgaattctgtctaggactggttcaatgatgacaacccaatgtcatgaagaaaggtgatgacataaaattcatgcacaataggattacgctgaggcccaaccagagcgacagggtcacaagaggtccattgactccttggggggctcttgggtgacttcccagaagacctcagatgtccttgccctgtttcccatgagaggaaatgtggatatctagggtgcacattggttggcaaacactccatgccaataagcacctagtcccacaatggaaccttgggcatttctgcaaggatcgtcccttgctcatgacaatgtcttttctggtgttttgcagtcatctcacaaccttggaaggcagagaatcacagataatcaggtaagtagtcagaacatggtaaagcctccacatccaggtgacctcccctttcatgctttggctttcaattcttggccaggctgtccttttggaatttggggataacaaaatggtatgcaacggtactaaaggagctcgatttaggctatgttctcccatgcagatcccctgatttgtaaagttttagaaatatgttcaactcccgataattgttttttcataattttgacctacttctcatggagagaggaggatgacattttttgaatgttgggatctcatactttgatgcttacaattccattggaaaaagctacaggaggacaacacaggcctccagggccttatgggactcttcctttcccttgacaggggaggcccaaatgacagagcctttcttagggaaaaagaaggattctatgatatccaaaaaggctgtcctccccatggtgggttcacaatgggcaatccctctagcagatattccaacgatctctccccagagacaatttacccatgtggatagggtgagatattcatttttaccttggtacccaccacattccaaatttccttcatggtatcatttagggcacttactgaacctcaccacagaatcactgaggaaaaaaagctctacacattaggttgacacagggtaaggccaggtgtttagagaacctaattccactttgattcataactccaaggtctgacttgagtccagcaacagtggttaccctcatgttttacagcagggcaacccataaaacctttacacaaatggttccacgtatagacatgggttttgtggactgggcccaggattttcgggagattttcaggaatcacctttcacgttgagtcgggtcatacaacatagacctttcagaggtctgatgccacatttgcactttgagcaaaaacacacagatactttaatcaccctccaaatacctatctgtagttgttttattcaattatttttttgtcctatccatagaactttggcagctcaacttgagtgttgatacctacaaaattgtgaggctaaggtcacatgtgatgtggcttttgctttgagaggaagcattaaatctttactggaatgccagggttccttcctatgtccgctgatgtttctctatggtagccaggaagacttgtgtgtgctgggctggtagtaatacaagaggtaaccccaggacagtttctgcacaatgaagttgtgcctgtagagctccagaaaaatgtctctctcctctgacctttatttaagaatggacaacaagtgccttgacttctttctctttcctccttagggaagacattcttccaagtatcaagaaagggagcccttccttccctagaagacatttcgttccagcaatccctctccagttccatgtgaccattcctactctgagccagttttggaaaggtaggtaattggttggattaggttaggtgatatccaagtaagatagccgaattctgtctaggactgggtcaatgatgacaacccaatgtcatgaagaagagtgatgacataaaattcatggtcaataggattacactgagacacaaccagggcgacagggtcacaggaggtccattgactccttaaggggctcttgggtgacttccctgaagtcctcagatgcccttgccctgtttcccataagaggaaatgtggacatctagggtgcacattggttggcaaacactccatgccaacaagcaccttttcccacattggaaccttgggcgtttctgcaaggatcgtcccttgctcatgaaaatgtcttttctcttgttttgcacttatgtcacaagccaccttggaaggcagagaaacacagataatcaggtaagtggtcagaatatggtaaagcctccacatccaggtgaccgcccccttcatgctttggctttcaattcacagccagtctgtccttttggaatttggggataacaaaatggtatgcaacagtaccaaaggagctcgatttatgctatgttctcccatgcagatcccctggtttgtaaagttttaggaatatattcaactcccgataattgttttttcataatttttacctacttctcatggagagaggaggatgacattttttgaatgttgggatctcatactttgatgcttacaattccatggcaaatagctacaggaggccaacacaggcctcaaggccttatgggactcttcctttcccttgacaggggaggcccaaatgacagagcctttcttagggaaaaagaaggattctatgatatccaaaaaggctgtcctccccatggtgggttcacaaagggcaatccctctagcagatattccaacgatctctccccagagacaatttacccatgtggatagggtgagatattcatttttacctggtgcccaccacattccaaatttccttcatggtatcatttagggcacttactgaacctcaccacagaatcactgaggaaaaaaagctctacacattaggttgacacagggtaaggccaggtgtttagagaacctaattccactttgattcataactccaaggtctgacttgagtccagcaacagtggttaccctcacgttttacagcagggcaacccataacacctttacacaaatggttccatgtatagacatgggttttgtttactgggcccaggattttcgggagattttcaggaatcacctttcacgttgagtcgggtcatacaaatagacctttcagaggtctgatgccacatttgcactttgagcaaaaacacacagttactttaatcaccctcgaaatacctatctgtagtttttttattcaattatttttttgtcctatccatagaactttggcagctcaacttgagtgttgatacctacaaaattgtgaggctaaggtcacatgtgatgtggctgttgctttgagaggaagcattaaatctttactggaatgccagggttccttcctatgtccgctgatgtttctctatggtagccaggaagacttgtgtgtgctgggctggtagtaatacaagaggtaaccccaggacagtttctgcacaatgaagttgtgccagtatagctccagaaaaatgtctctctcctctgaccttcatttaagaatggacaacaagtgccttgacttctttctctttcctccttagggaagacattcttccaagtatcaagaaagggagcccttccttccctagaagacatttcgttccagcaatccctctccagttccatgtgaccattcctactctgagccagttttggaaagtaggtaattggttggattaggttaggtgatatccaagtagaggtagcagaattttgtctaggactgggtcaataatgacaacccaatgtcatgaagaagagtgatgacataaaattcatgctcaataggattacgctgagacccaaccagggcgagagggtcacaggaggtccattgactccttggggggctcttgggtgaattccctgaagtcctcagatgcccttgccctgtttcccataagaggaaatgtggacatctagggtgcacattggttggaaaacactccatgccaacaagcacctagtcccacattggaaccttgggcatttctgcaaggatcgtcccttgctcatgaaaatgtcttttctgttgttttgcagttatgtcacaagccaccttggaaggcagagaaacacagataatcaggtaagtggtcagaatatggtaaagcctccacatccaggtgacctcccccttcatgctttggctttcaattcacagccagtctgtccttttgtaatttggggataacaaaatggtatgcaacagtaccaaaggagctcgatttaggctatgttctcccatgcagatcccctggtttgtaaagttttaggaatatgttcaactcccgataattgtattttcataattttgacctacttctcatggagagaggatgacattttttgaatgttgggatctcatactttgatgcttacaattccatggcaaatagctacaggaggacaacacaggcccccagggctttatgggactcttcctttcccgtgacaggggaggcccaagtgacagagcctttcttagggaaaaagaaggattctatgatatccaaaaaggctgtcctccccatggtgggttcacaaagggcaatccctctagcagatattccaccgatctctccccagagacaatttacccatgtggatagggtgagatatacatttttacctggtgcccaccacattccaaatttccttcatggtatcatttagggcacttactgaacctcaccacagaatcactgaggaaaaaaagctctacacattaggttgacacagggtaaggccaggtgtttagagaacctaattccactttgattcataactccaaggtctgacttgagtccagcaacagtggttaccctcacgttttacagcagggcaacccataacaccttgacacaaatggatccatgtatagacatgggttctatggcctgggcccaggattatcgggagattttcaggaatcacctttcacgttgagtcgggtcatacaacatagaccttacagaggtctgatgccacatttgcactttgagcaaaaacacacatttactttaatcaacctcgaaatacctaactgtagttgttttattcaattattttttgtcttatccatagaacttgggcagctcaacttgagtgttgatacctacaaaattgtgaggctaaggtcacatgtcatgttgctgttgcttcgagaggaagcagtaaatctttattggaatgccagggttcctttgtgtggccactgatgtttctctatggtagccaggaagacttgtgtgtgctgggctggtagtaatacaagaggtaacaccaggacagtttcttttttttttttttatttttttttcctttccattttattaggtatttagctcatttacatttccaatgctataccaaaagtcccccataaccacccacccccactcccctacctgcccactccccctttttagccctggcgttcccctgttctgtggaatataaagtttgtgtgtccaatgggcctctctttccagtaatggccgactaggccatcttttgatacatatgcagctagagtcaagagctccggggtactggttagttcataatgttgaaccacctatagggttgcagatccctttagctccttgggtactttctctagctcctccattgggagccctgtgatccatccattagctgactgtgggcatccacttctgtgtttgctaggcccctgcatagtctcacaagagacagctacatctgggtcctttcgataaaatctagctagtgtatgcaatggtgtcatcgtttggatgctgattatcgggtggatccctggataaggcagtctctacatggtccatcctttcatctcagctccaaactttgtctctgtaactccttccaagggtgttttgttcccacttctatggaggggcatagtgtccacacttcagtcttcatttttcttgagtttcatgtgtttaggaaattgtatcttatatcttgggtatcctaggttttgggctaatatccacttatcagtgagtacatattgtgtgagttcctttgtgaatgtgttacctcactcaggatgatgccctccaggtccatccatttggctaggaatttcataaattcattctttttaatagctgagtactactccattgtgtagatgtatcacattttctgtatccattcctctgttgaggggcatctgggttctttccagattctggctattataaataaggctgctatgaacatagtggagcatgtgtccttcttaccagttggggcatcttctggatatatgcccaggagaggtatggctggatcctccggtagtactatgtccaattttctgaggaaccgccagacggatttccagagtggttgtacaagcctgcaatcccaccaacaatggaggagtgttcctctttctccacatcctcgccagcatctgctgtcacctgaatttttgatcttagacattctgactggtgtgaggtggaatctcagggttgttttgatttgcatttccctgatgattaaggatgttgaacattttttcaggtgtttctctgccattcggtattcctcaggtgagaattctttgttcagttctgagccccattttttaatggggttatttgattttctgaagttcaccttcttgagttctttatatatgttggatattagtcccctatctgatttaggataggtaaagatcctttcccagtctgttggtggtctttttgtcttatagacagtgtcttttgccttgcagaaactttggagtttcattaggtcccatttgtcaattctcgatcttacagcacaagccattgctgttctgttcaggaattttttcccctgtgcccgtattttcaaggcttttccccactttctcctctataagtttcagtgtctctggttttatgtgaagttctttgatccatttagatttgaccttagtacaaggagataagtgtggatcgattcacattcttctacatgataacaaccagttgtgccagcaccaattgttgaaaatgctgtctttcttccactggatggttttagctcccttgtcgaagatcaagtgaccataggtgtgtgggttcatttctgggtcttcaattctattccattggtctacttgtctgtctctataccagtaccatgcagtttttaccacaattgctctgtagtaaagctttaggtcaggcatggtgattccaccagaggttcttttatccttgagaagagtttttgctatcctaggttttttgttattccagatgaatttgcaaattgctccttctaattcgttgaagaattgagttggaattttgatggggattgcattgaatctgtagattgcttttggcaagatagccatttttacaatgttgatcctgccaatccatgagcatgggagatctttccatcttctgagatcttctttaatttctttcttcagagacttgaagtttttatcatacagatctttcacttccttagttagagtcacaccgagatattttatattatttgtgactattgagaagggtgttgtttccctaatttctttctcagcctgtttattctttgtgtagagaaaggccattgacttgtttgagttaattttatatccagctacttcaccgaagctgtttatcaggtttaggagttctctggtggaatttttagggtcacttatatatactatcatatcatctgcaaaaagtgatattttgacttcctcctttccaatttgtatccccttgatctccttttgttgtcgaattgctctggctaatacttcaagtactatgttgaaaaggtagggagaaagtgggcagccttttctagtccctgattttagtgggtttgcttccagcttctctccattaactttgatgttggctactggtttgctgtagattgcttttatcatgtttaggtatgggccttgaattcctgatctttccagaacttttataatgaatgggtgttggatcttgtcaaatgctttttctgcatctaacgagatgatcatgtggtttttgtttttgagtttgtttatatagtggattacattgatggattttcgtatattaaaccatccctgcatccctggaataaaacctacttggtcaggatggatgattgctttaatgtgttcttggattcggttagcgagaattttattgaggatttttgcatcaatattcataagagaagttggtctgaagttctctatctttgttggatctttctgtggtttaggtatcagagtaatagtggcttcataaaatgagttgggtagagtaccttctacttctatcttgtgaaaaagtttgtgcagaactggaattagatcttctttgaaggtctgatagaactctgcactaaacccgactggtcctgggctttttttggctgggagactatttataactgcttctatttctttaggggatatgggactgtttagaaggtcaacttgatcctgattcaactttggtacctggtatctgtccagaaatttgtccatttcgtccaggttttccagttttgttgagtatagccttttgtagaaggatctgatggtgttttggatttcttcaggatctgttgttatgtctcccttttcagttctgattttgttaattaggattttgtctctgtgccctctagtgagtctagctaagggtttatctatcttgttgattttctcaaagaaccaactcctcgtttggttaattctttgaatagttcttcttgtttccacttggttgatttcacccctgagtttgattatttcctgccgtctactcctcttgggtgaatttgcttcctttttttctagagctttttttttttttccattttttattaggtatttagctcatttacatttccaatgctatactaaaagtcccccttacccacccacccccactcccctacccacccactccccccctttggccctggcgttcccctgtaccggggcacacaaagtctgcgtgtccaatgggcctctctttccagtgatggccgactaggccatcttttgatacatatgcagctagagtcaagagctcaggggtactggttagttcataatgttgttccacctatagggttgaagatccctttagctccttgggtactttctctagctcctccattgagagccctgtaatccatccattagctgactgtgagcatccacttctgtgtttgctaggccccggcatagtctcacaagagacagctacatctgggtcctttcagtaaaatcttgctagtgtatgcaatggtgtcagcatttggaagctgattatggggtggatccctggatatggcagtctctacatggtccatcctttcatctcagctccatactttgtttctgtaactccttccatgggtgttttgttcccacttctaaggaggggcatagtgtccacacttcagtcttcatttttcttgagtttcatgtgtttaggaaattgtatcttatatcgtgggtatcctaggttttgggctagtatccacttatcagtgagtacatattgtgtgagttcctttgtgattgtgttacctcactcaggatgatgctctccaggtccatccatttggctaggaatttcataaattcattctttttaatagctgagtagtactccattgtgtagatgtaccacattttctgtatccattcctctgttgaggggcatctgggttctttccagtttctggctattataaataaggctgctatgaacatagtggagcatgtgtccttcttaccagttggggcttcttctggatatatgcccaggagaggtattgctggatcctccggtagtactatgtccgattttctgaggaaccgccagactgatttccagagtggttgtacaagcctgcaatcccaccaacaatggaggagtgttcctctttctccacatcctcgccagcatctgctgtcacctgaatttttgatcttagccattctcactggtgtgaggtggaatctcagggttgttttgatttgcatttccctgatgattaaggatgttgaacattttttcaggtgcttctctgccattcggtattcctcaggtgagaattctttgttcagttctgagccccattttttaagggggttatttgattttctgaggtccaccttcttgagttctttatatatgttggatattagtcccctatctgatttaggataggtaaagatcctttcccagtctgttggtggtctttttgtcttatagacagtgtcttttgccttgcagaaactttggagtttcattaggtcccatttgtcaattctcgatcttacagcacaagccattgctgttctgttcaggaatttttcccctgtgcccatatcttcaaggcttttccccactttctcctctataagtttcagtgtctctggttttatgtgaagttccttgatccacttagatttgaccttagtacaaggagataagtatggatcgattcgcattcttctacatgataacaaccagttgtgccagcaccaattgttgaaaatgctgtctttcttccactggatggttttggctcccttgtcgaagatcaagtgaccattggtgtgtgggttcatttctgggtcttcaattctattccattggtccacttgtctgtctctataccagtaccatgcagtttttatcacaattgctctgtagtaaagctttaggtcaggcatggtgattccaccagaggttcttttatccttgagaagagtttttgctatcctcggttttttgttattccagatgaatttgcaaattgctccttctaattcgttgaagaattgagttggaattttaatggggattgcattgaatctgtagattgcttttggcaagatagccatttttacaatgttggtcctgccaatccatgagcatgggagatctttccatcttctgagatcttctttaatttctttcttcagggacttgaagtttttatcatacagatctttcacttccttggttagagtcacgccgagatattttatattatttgtggctattgagaagggtgttgtttccctaatttctttctcagcctgtttattctttgtgtagagaaaggccattgacttgtttgagttaattttatatccagctacttcaccgaagctgtttatcaggtttaggagttctctgttggaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagaaagtgggcagccttgtctagtccctgattttagtgggattgcttccagcttctctccatttactttgatgttggctactggtttgctgtagattgcttttatcatgtttaggtattggccttgaattcctgatctttccaacacttttatcatgaatgggtgttggatcttgtcaaatgctttttctgcatctaacgagatgatcatgtggtttttgtctttgagtttgtttatataatggattacattgatggattttcgtatattaaaccatccctgcatccctggaataaaacctacttggtcaggatggatgattgctttaatgtgttcttggattcggttagcgagaatttttttaaggatttttgcatcgatgttcataagagaaattggtctgaagttctctatctttgttggatctttctgtggtttaggtatcagagtaatagtggcttcataaaatgagttgggtagaataccttctacttctatcttgtgaaaaagtttgtgcagaactggagttagatcttctttgaaggtctgatagaactctgcactaaacccgtctggtcctgggctttttttggctgggagactattaataactgcttctatttctttaggggatatgggactgtttagaaggtcaacttgatcctgattcaactttggtacctggtatctgtccagaaatttgtccatttcgtccaggttttccagttttgttgagtatagccttttgtagaaggatctgatggtgttttggatttcttcaggatctgttgttatgtctcccttttcatttctgattttgttaattaggattttgtccctgtgccctttagtgagtgtagctaagggtttatctatcttgttgattttctcaaagaaccaactcctcgtttggttaattctttgaatagttcttcttgtttccacttggttgatttcacccctgagtttgattatttcctgccgtctactcctcttgggtgaatttgcttcctttttttctagagcttttagatgtgttgtcaagctgctagtatgtgctctctcccgttttttcttgaaggcactcagagctatgagtttccctcttagaaatgctttcattgtgtcccataggtttgtgtatgttgtggcttcattttcattaaactctaaaaagtctttaatttctttctttattccttccttgaccaaggtatcattgagaagagtgttgttcagtttccatgtgagtgttggctttctgttattttttttttttgttattgaagatcagccttagtgcatggtgatctgataggatacatgggacaatttcaatatttttgaatctgttgaggcctgttttgtgacctattatgtggtcaattttggagaaggtaccatgaggtgctgagaagaaggtatatccttttgttttaggataaaatgttctgtagatatctgtcagatccatttgtttcatcacttctgttagtttcagtgtgtccctgtttagtttctgtttccatgatctgtccattggtgaaagtggtgtgttgaagtctcccactattattgtgtgaggttcaatgtgtgctttgagctttactaaagtgtctttaatgaatgtggctgcccttgtatttggagcatagatattcagaattgagagttcctcttggagggttttacctttgatgagaacgaagtgcccctccttgtcttttttgataactttgggttggaagtcaatcttatcagatattaggatggctactccagcttgtttcttcataccatttgcttggaaaattgttttccagccttttattctgaggtagtgtctatctttttctctgagatgtgtctcctgtaaacagcaaaatgttgggtcttgtttgtgtagccagtttgttagtctatgtctttttattggggagttgagaccattgatgttaagagatattaaggaaaagtaattgttgcttcctgttatttttgttgttaaagttggcattctgttcttgtggctgtcttcttttaggtttgttgagggattaccttcttgttttttctagggcattgttcccgttcttgtattggtttttttctgttattaacctttgaagggctggattcgtggagagataatgtgtgaatttggttttgtcgtggaatactttggtttctccatctatggtaattgagagtttggctgggtatagtagcctgggctggaatttgtgttctcttagtgtctgtataacatctgtccaggctcttctggctttcatagtctctggtgaaaaatctggtgtaattctgataggcttgcttttgtatgttacttgacctttttcccttactgcttttagtattctatctttatttagtgcatttgttgttctgattattatgtgtcgggaggaatttcttttctggtccagtctatttggagttctgtaggcttcttgtatgttcataggtatctctttctttatatttgggaagttttcttcaataattttgttgaagatgtttgctggtcctttgagttgaaaatcttcattctcatccactcctattatccgtaggtttggtcttctcattgtgtcctggatttcctggatattttgagttaggatctttttgcattttctattttctttgattgtcgtgccgatgttctctatggaatcttctgcacctgagattctctcttccatcccttgtattctgttgctgatgctcaaatctatgcttccagatttctttcctagggtttctatctccagtgttgcctcactttgagttttctttattgtgtctacttccctttttaggtctagtatggttttgttcatttccatcacctgtttgtatgttttttcctctttttctgtaaggacttctacctgtttgattgtgttttcctgtttttctttaaggacttgtaactctttagcagtgttctcctgtatttctttaagtgatttattaaagtccttcttgatgtcctctaccatcatcatgagatatgcttttaaatctaggtctaggttttcgggtgtgttggggtgccctggactgggcgaagtgggagtgctgggttctgatgatggtgagtggtcttggttcctgttagtaggattcctacatttacctttcgccatctggtaatctctggagttagtagttatagttgactctgtttagagattgttcttctggtgattctgttaccggctctcagcagacctgggagacagattctctcctctgagtttcagtgctcagagcactctctgctggcaagctctcttacagggaaggtgcgcagatatcttgtttttggacctcctcctggtcgaagaagaaggcccaaaacagggcctctctcagaagctgtgttgctttggcagttcctagaagctgtcagcttctgtggtgcagactctcacctgtgcagactaaattcctaagttccagggagtcctggaaccaagatggcgacctctgctcctgaggctgaggccgcctcccgagccaggcagacacctgtcctctggtccggacagtggacggctgtctgcagcccgccaagggtgctgcctcagtggctttgtgcttctgcccgtcccagaagctgtccggttctctggcgcaccctctaacctgttcagactaatttcctaggtaccgcggagacctggaacccagatggcgaccactgctgctgaggctgaggccgcctccaaagccaggcagacacctgtcctctggtccggacggtggccggctgtctgcggcccaccaagcactaggacagtttctgcacaatgaagttgtgccagtagagctccagaaaaatgtctctctcctctgacctttatgtacagaagggacaacaagcgccttgacttctttccctttcctccttagggaagacaatcttccaagtatcaagaaagggagcccttgcttccctggaggacatttcgtcccagcaatccctctccagttccatgtgaccattcctactctaagccagttttggaaaggaaggtaagtggttggattaggttaggcgatatccaagtaggggtaggctaattctgtctaggactgggtcaatgatgacaacccaatgtcatgaagaaaggtgatgacataaaattcatgctcaataggattacgctgaggcccaaccagggcgacagggtcacaagaggtccgttgactccttggggggctcttgggtgacttccctgaagtcctcagatgcccttgccctgtttcccataagaggaaatgtggacatctagggtgcacattggttggcaaacactgcatgccaacaagcacatagtcccacaatggatccttgggaatttctgcaaagatcatcccttgctcatgacaatgtcttttctggtgttttacagtcatctcacatgccaccttggaaggcagagaaacacagataatcaggtaagtggtcagaacatggtaaagcctccacatccaggtgacatcccccttgatgctttggcttgaaattctcagccagtctgtccttttggaatttggggataacaaaatggtatgcaacggtaccaaaggagctcgatttaggctatgttctcccatgcagatcccatggtttgtaaagttttaaggaatgtgttcaactcccgataattgttttttcataattttgacctacttctcatggatagaggaggatgacattttttgaatgttgggatctcatactttgatgcttacaattccatggcaaatagctacaggaggacaacacaggcctccatggccttatgggactcttcctttccattgacaggggaggcccaagtgaaagagcctttcttagggaaaaagaaggattctatgatatccaaaaaggctgtcttccccaggatgtgttcaaaaagggcaatccctctagcagatattccaaagatctcaccccagagacaatttacccatgtggatagggtgagatattaattttttccgtggtgcccaccacatgccaaatttccttcatggtatcatttagagcacttactgaacctcaatgcagaatcactgaggaaaaaaagctctacacattaggttgatacagggtaaggccaggtgtttaaagaacctaattccaccttgattcaaaacaccaaggcctgacttgagtccagcaacagtggataccctcacgttttacagcagggcaacccataacaccttgacacaaatggatccatgtatagacatgggttttatggcctgtgtccaggattctggggagattttcaggaatcacctttcacattgagtcgggtcatacaacatagacctttcagaggtctgatgccacatttgcactttgagcaaaaacacacagttactttaatcaccctcgaaatacctatctgtagttgttttattcaattatttttttgtactatccatagaacttgggcagctcaacttgagtgttgataccaaaaaattgtgaggctaaggtcacatgtgatgtggctgttgtttcgagaggaaaaagtaaatctttattgaaatgccagggttcctttgtgtggccactgatgtttctctatggtagccaagaagacttgtgtgtgctgggctggtagtaatacaagatttaaccccaggacagtttctgcacaatgaagttgtgccagtagagctccagaaaaatgtctctctcctctgacctttatttaaagaagggacaacaagcgccttgacttctttccctttcctccttagggaagacattcttccaaatatcaagaaagggagcccttgcttccctggaagacatttcctccagcaatccctctccagttccatgtgaccattcctactctgagccagttttggaaaggaaggtaagtggttggattaggttaggtgatgtccaagtagaggtagccgaattctgtctaggactgggtcaatgatgacaacccaatgtcatgaagaaaggtgatgacataaaattcatgctcaataggattacactgaggcccaaccagggtgacagggtcacaacaggtccgttgactccttgaggggctcttgggtgacttccctgaagtcctcagatgaccttaccctgtttcccatgagaggaaatgtggacatctagggtgcacattggttggcaaacactgcatgccaacaatcaccgagtcccacaatggaaccttgggcatttcagcaaggatcttcccttgctcatgacaatgtcgtttctggtgttttgcagtcatctcacatgccaccttggaaggcagagaaacacagataatcaggtaagtggtcagaacatggtaaagccaccacatccaggtgacctcccccttcatgctttggctttcatttcacagccagtctgtccttttggaatttggggataacaaaaagttatgcaacggtaccaaaggagcacgatttaggctatgttctcccatgcagattccctggtttgtaaagttttaaagaatgtgttcaactcccgataattgttttttcataattttgacctacttctcatggagagaggaggatgatattttttgaatgttgtgatctcatactttgatggttacaattccatggcaaatagctacaggaagtcaacacaggcctccagggacttattggacacttcctttcccttgacagtaaggcccaagtgacagaacatttcttagggaaaaagaaggattctatgatatccaaaaaggctgtcctccccaggatgggttcacaaagggcaatccctctagcagatattccaaagatctcaccccagagacaatttccccatggggatagggtgagatatttatttttacctggtgcccaccacattccaaatttccttcatggtatcatttaggggacttactgaacctcactgcagaatcactgaggaaaaaaagctctacacattaggttgttacatggtaaggccaggtgtttaaagaacctaattccactttgattcataacaccaaggcctaacttgagtccagcaacagtggttaccctcacgttttacagcagggcaacccataacaccttgacacaaatggatccatgtttagacaggggttctgttgcctgggtccaggattctcgggagattttcaggaatcacctttcacattgagtcgggtcataaaacatagaccttacagaggtctgatgccacatttgcactttgagcaaaaacacacagttactttaatcaccctcctactacctatctgtagttgttttattcaattatttttttgtcctatccatagaacttgggcagctcaacttgagtgttgataccaaaaaattgtgaggctaaggtcacatgtgatgtggctgttgcttccagaggaagaagtaaatctttattggaatgccagggttcctttgtgtgtccactgatgtttctctatggtagccaggaagacttgtgtgtcctgggctggtagtaatacaagaggtaaccccaggacagtttctgcacaatgaagttgtgccagtagagctccagaaaaaactctctctcctctgacctttatttaaagaagggacaacaagcgccttgacttctttccctttcctccttagggaagacattcttccaagtatcaagaaagggagcccttgcttccctggaggacctttcctcccagcaatccctctccagttccatgtgaccattcctactctgagccagttttggaaaggaaggtaagtggttggattaggttaggtgatatccaagtagaggtagccgaattctgtctaggactgggtcaatgatgacaacccaatgtcatgaagagtggtgatgacataaaattcatgctctacaggattacgctgaggcccaaccagggcgacagggtcacaacaggtccgttgactccttgggcggctcttgggtgacttccctgaagtcctcagatgcccttgccctgtttcccatgagaggaaatgtggacatctagggtgcacattggttggcaaacactgcatgtcaacaaccacctagtcccacaatggaatcttgggcatttctgcaaggatcatcccttgctcgtgacaatgtcttttctggtgttttgcagtcatctcacatgccacattggaaggcagagaaacacagataatcaggtaagtggtcagaacatggtaaagcctccacatccaggagacctcccccttcatgttttggctttcaattctcagtcagtctgtccttttggaatttggggataacaaaatggtatgcaacagtaccaaaggagctttatttaggctatgttctcccatgcagatcccctggtttgtaaaattttaaggaatgtgttcaactcccgataatttttttttcatgattttgacctacttctcatggagagaggaggatgacattttttgaatgttgggatctcatactttgatgcttacaattccatggcaaatagctacaggaggtcaacacaggcctccagggccttatgggactcttcctttcccgtgacaggggaggcccaagtgacagagcctttcttagggaaaaagaaggattctattatatccaaaaaggctgtcgccccaggatgggttcacaaagggcaatccctccagcagatataccaaagatctcaccccagagacaatttacccatgtggatagggtgagatattcatttttaccttggtgcctaccacattccaaatttccttcatggtatcatttagggcacttactgaacctcacagcagaatcactgaggaaaaaaagctctacatattaggttgatacagggtaaggccaggtgtttaaagaacctaattgcactttgattcacaacaaggtctgacttgagtccagcaacagtggttaccctcacgtattacagcagggcaacccataacaccttgacacaaatgtatccatgtatagacatgggttttgtggcctgggcccaggattctcgggagattttcaggaatcacctttcatgttgagtcgggtcatacaacatagaccttacagaggtctgatgccacatttgcactttgagcaaaaacacacagttactttacacactcgaaatacctatctgtagttgttttattcaattatttttttgtcctatccatagaacttgggcagctcaacttgagtgttgatacctacaaaattgtgagtctaaggtcacatgtgatgtggctgttgctttgagaggaagcagtaaatctttattggaatgtcagggttcctttgtgtgtccactaatttttctctatggtagccaggaagacttgtgtgtgctgggctggtagtaatataagaggtaaccccaggacagtttctatacaatgaagttgtgccagtagagctccagaaaaatgtctctctcctctgacctttatttaaagaagggacaacaagcaccttgacttctttccctttactccttagggaagacattcttccaagtatcaagaaagggagcccttgcttccctggaagacatttcctcccagcaatccctctccagttccatgtgaccatgcctactctgagccagttttggaaaggaaggtaagtggttggattaggttaggtgatatccaagtagaggtagccgaattctgcctaggactgggtcaatgatgacaacacaatgtcatgaagaaaggtgatgacataaaattcatgctcaataggattactttgaagcccaaccagggcgacaggttcacaagaagtccgttgaatccttgggggactcttgggtgacttccctgaagtcctcagatgccccttgcagtgtttcccatgagcggaaaagtggacatctagggtgcacattggttggcaaacactgcatgccaacaagcacctagtcccacaatggaaccttgggcatttctgcaaggatcgcaccttgctcatgacaatgtcttttctggtgttttgcagtcatctcacatgccaccttgggaggcagagaaacacagataatcaggtaagtggtgagaacatggtaaagcctccacatccaggtgacatcccccttcatgttttggctttcaattctcagtcagtctgtccttttggaatttggggataacaaaatggtatgcaacggtaccaaagaagctcgatttaggatatgttctcccatgtagatccccttgtttgtaaagtattaaggaatgtgttcaactccggataatttttttttcataattttgacctacttctcatggagagaggaggatgacattttttgaatgttgggatctcatactttgatgcttactattccatggcaaatagttacaggaggacaacacaggccccgagggctttatgggactcttcctttcccatgacaggggatgcccaattgacagagcctttcttagggaaaaagaaggattctatgatatacaaaaaggctgtcctccccaggatgggttcacaaagggctatccctctagcagatattccaaagatctcacctcagagacaatttaccaatgtggatagggtgagatattcatttttaccttggtgcccaccacattccaaatttccttcatggtatcatttatggcacttactgaacctcactgcagaatcactgaggaaaaaaagctctacacattaggatgatacagggtaaggccaggtgtttaaagaacctaattccactttgattcataacaccaaggcctgacttcagtccagcaacattggttaccctcacgttttacagcagggcaatccataacaccttgacacaaatggatccatgtatagacatgggttctgtggcctgggtccaggattctcgggagattttcaggaatcacctttcacgttgtgtcgggtcgtacaaagtagaccttacagaggtctgatgccacatttgcactttgagcaaaaacacacagttactttaatcaccctcgaaatacctatctgtagttgttttattcaattattttttgtcttatgcatagaacttgggcagctcaacttgagtgttgatacctacaaaattgtaaggctatggtcacatgtgatgttgctgttgcttcgagaggaagcagtaaatctttattggaatccagggttcctttgtgtgtccactgatgtttctctatggtagccaggaagacttgtttgtgctgggctggtaataatacaagaggtaaccccaggaaagtttctgcacagtgaagttgtgccagtagagctccagaaaaatgtgtctctcctctgacctttatttaaagaagggacaacaagcgccttgacttctttccctttcctccttagggaagacattcttgcaggtatcaagaaagggagcccttgcttccctggaagacatttcgtcctagcaatccctctccagtttcatatgaccattcctactctgagccagttttggaaaggagggtgagtggttggattaggttaggtgatatccaagtagaggtagccgaattctgtctaggactgggtcaatgatgacaacacaatgtcatgaagaaaggtgatgacataaaagtcatgctcaataggattacgctgaggcccaaccagggcgacagggtcacaagaggtacgttgactccttggggggctctagggtgacttccctgaagtcctcagatgcccttgccctgtttcccatgagaggaaatgtggacatgtagggtgcacattggttggcaaacactgcatgccaacaagcacctagtcccacaatggaaccttgtgcatttctgcaagaatcgtcccttgctcatgacaatgtcttttctagtgttttgcagtcatctcacatgccaccttggaaggcagagaaacacagataatcaggtaagtggtcagaacatggtaaagcctccacatccaggtgacctaccccttcatggtttggcttttaattctcagtcagtctgtccttttagaatttggggataacaaaatggtatgcaatggtaccaaaggagctcgatttaggctatgttctcccatgtagatcccctggtttgtaaagttttaaggaatgtgttcaactccctataattttttttcataattttgacctacttctcatggagagaggaggatgacatttttgaatgttgggatctcatactttgattcttaccattccatggcaaatagctagaggaggacaacacagtcccccagggctttatgggactcttcctttcccttgacaggggaggcccaagtaacagagcctttcttagggaaaaagaaggattctatgatatacaaaaaggctgtcttccccaggatgggttcacgaagggcaatccctctagcagatattccaaagatctcaccccagagacaatttacccatgtggatagggtgagataatcatttttaccttggtgcccaccacattccaaatttccttcatggtatcatttagggcacttactgaacctcacagcagaatcactgaggaaaaaaaggtctacacattaggttgatacagggtaaggccaggtgtttaaagaacctaattccactttgattcataacaccaaggcctgacttgagtccagcaacagtggttaccctcacgttttacagcagggcaacccataatgtagtctcccctcccccagcctgaaacctgcttcctcaggtgtggagcttcctgctcatttgttctgccatgcccactgctggaacctgcgcagccacacacgtgcacctttctactggaccagagattattcggagggaatcgggtcccctcccccttccttcataactagtgtcgcaacaataaaatttgagctttgatcagagtaactgtcttggctacatctctttctctcgccacctagcccctcttctcttccaggtttccaaagtgcctttccacgctagaacccaggttgtggtctgctggccggacacaacaattggcaaaccaacgcgggactgagaaacggcaaaggatttttggaagagacgctgctggttcggagctccataaaataaaggataaaggaaattcataccggagaaggtatgggctaagctgagacagcgttaaaccctagcgctggttcacttaggttcagtagtgaggagctgggtaataggcggtaggctgtagctctctgaagctacatgaggcgtgagaaaagaaagggtttattaaaaggaatatgcggattgccccagttaataaaaaatgcatcataagggaggaaaatgtcccaaaaagcagagagaaatttctctctgggccttatagcaggagtactctgttcccttttgtgtcttgtctaatgtccggtgcaccaatctgttcttgtgttcaattcatgtatgttcgtgtccagtctgtatgaatgaatgttctatgttttatgttggataataaagatggtataaaaaactttatctgcaaagccaagagctgccacgtgtttcagccaggaatcagacacgtggcgggagggcccctgctagaaaaactgttcgttttaggaaataagggcgagtgcacagcctcttagtttcggagtaaaaaagctaataaatggttcatgattaatgtgtttgacaatggtaaagtgttttttattctatgattgtagctacaaaaattattattctctgattggtctaaatgtaactgcttcatttggttcttttttattggtaatgtgctctgagtgtcttcacattcagctcattagttgttggttaagattaataattgttacattgctacagatgtttagtgttaaatttgataactcaagtttagagtccttccgacacgtggcataaagcaggccaagaggctgggtctctaaagatatttctagtttaggtaataattaatgtggttcgtatcctaaatagtaaaatttaagataagatttaaagcaatgtctctttattaaagcattaaagcttgctttaataggtattcataggtattaattgacatccaaacttcgtaatatgatagtaatgcttctaatattgattttaaagataataaattgttttaaacttgggttttgctttcccaaggttataggtattatcctaaccttgcacaaaaaacttaaaaattatggttaaaactgctattgttccattgactgcagcttgcagtttgatttcaaatttaagatctttaattcacctgtatactgtaattaagataattacaagagtaatcatattatgagagcgctcatacagctcacttcatacaaaactgtgacaaagttatctagttatgtttgtctttgtgaatagattagacaaacagtttggttatagttgctgcctggcaggaaactgcagtacgggcaattttttcacaacactaaagttgtgaagaacgttttaactgtaagtcatcttaagaaagagtatcacaatttagaggcatagacagttatattgtttctctagaatcggtccttattacaagagggccaagatgctcagattaaaaagtattttacctttgagtcaatacatggctccgggcagccccagagcagcttgtggcctttcttttgttttgcaaacagtgcctgagaaagtttttttccctatgttcaagagaatttctttttaacagtgttacagatctattcacatgtttaaaataatgctttaattcaaagagttttgcttctagtgaactgtaatcactagaaaattctgcctctaggtatggctaatgtaactttacattatgtaagaaaaatttttattgtttctgcttctaaacaagaagccaagagttttaatctttcagtgtatattgtttcctaagtgaaaagtatattaactaatgcttcttaaagtttaccttaaattcttgctctcacccaaaagattcagagacaatatccttttattacttagggttttagtttactacaaaagtttctacaaaaaataaagcttttataattgttattcattggtaattaaaaattggttgtgcccaaaacaattctttggccaaaaagaaaaacattattgtaaagtcatttttctcatcctcccagccgatcgttggcccacgtgggcccaactagcttctgtggggcagagtcttaagacacagtttcccctgttccagcacagatgatctagttgtgtgctgtagatggtgttttaaaatgctgaacaatcaaaccttaatttgtatattaatagtcaatgccatatctctgagctcgcaattgcttaaattgttcatccctcagatactattaattctcaaatttacaattgcttatgcatatttctagttaataaataaattatgcacatgtgactcttaataactttacaagccttctagttacaaccgctccctaagaaaattgattgaaaaaacaattggtcgcttaatacattggtaaaatggaaggaccccctgactaataaatggaagggtccagatccagttctaatttggggtaggggctcagtttgtgtttttttcatgagatgaagatggagcgcagtggctgccagagagattaatttgtcagatgaacacagattctgactcttctggtaagtatcattctaaagactaaaattccttttgtgcttaaaattcagctgagagcgaaagctcccaaagctgttctccagctactctctgagccagctccccgacaggagactagcctcagctttacaatttgcatttgaataaagtacctggacttccccaaaagaagttctgctttcctactttctcactgtcaagattttgtctttcaagcaggtaaatcaacattctcgagccagaccagcagatgtgcattcctgccccgcccccccttgagagcacaggtgacagctgttatctccattctcaggacattccagcacgtggccttcagtctgatttaaaatttaggttttcctagagggctagaaaagtagatatttctatattaataaagattggtttttattttgatagacaggcttagtcccttagctgacctctggcttttcacccttgctgttactgcaaggtgtccttaggctgtgaaaaaaacagggatgaagaggaacgacttccagctcctattttagccacaaatcgtggtgttactaatgacataattcttgcctaggtcttgctaaatctgaggttgataattctcctttaggagctgcacagcactcagagctgtgcatactggtttgtgatcatacaaattcagtatgggcatcgcttggtgcagagagcactgcaggggaaggtccagcttgaccatttctgagtttcctgtgagataaacccggtttaaaagaggttggtatcatattttggctaaaaaccaaaaatatttttcggctctgcctcacctccccaaaagataccgagagccacaggtgtgggtcttaacagcatccacgggaggaatcgggtcaatgtccacccaagccaaggttaaaagcccactcatctacggatgaagaaaatcatttgatcacctacctcagttaagcgttgccttatttaacttaattaataggggagagagagattggagaccatactgtcttcactgcctcccaccccaaaataaaacagccaattggccttgtactacagagccagtcgaacgccttctccctgtttcccacctatcatccaaaaatgcagaggaatatcaacttagtgttattcttattatagtgtatttcacatttattcagtcaaacttagccagagttccaacgccctacttaaattcaactagaaatttacctaacaagtactaattagcattataaagtcagagcctacagctccaggcttttcagttagttgtttactaaaataagaaaagacagtcttagccagatacagtttaccataagaaaagttaagaatcccacaaaagcaagttttttctttagccctagattccaggcagaactattgagcatagataatttttcctcctcaggccagctttttcttttttttaagttttgttaataaaagggaggagatgtagtctcccctcccccagcctgaaacctgcttgctcaggggtggagcttcctgctcattcgttctgccacgcccactgctggaacctgcacagccacacacgggcacctttatactggaccacagattattcggcgggaatcgggtcccctcccccttccttcataactagtgtcgcaacaataaaatttgagctttgatcagagtaactgtcttggctaaatcactttctctcgccacctagcccctcttcacttgcaggtttccaaaatgcctttccaggctagaacccaggttgtggtctgctggccagacacaacaccataacaccttgacacaaatggatccatgtatagacatgggttctgtggcctgggcccaggattcttgggagattttcaggaatcaccattcactttgagtcgggtcatacaacatagaccttacagaggtctgatgccacatttgcactttgagcaaaaacacacagtttctttaatcaccctccaaatacctatctgtagttgttttattcaattatttttttgtcctatccatagaacttgggcagctcaacttgagtgttgatacctacaaaattgtgaggctaaggtcacatgtgatgtggctgttgcttcgagaggaagcagtaaatctttattggaatgccaaggttcctttgtgtgtccactgatgtttctctatggtagccaggaagacttgtgtgtgcttggctggtagtaatacaagaggtaacccgaggacagtttctgcacaatgaagttgtgccagtagagctccagaaaaatttctctctcctctgacctttatttaaagaagggacaacaagcaccttgacttctttccctttccttcttagggaagacattcttccaagtatcaagaaagggagcccttgcttccctggaagacatttcgtcccagcaatccctctccagttccatgtgaccattcctactctgagccagttttggaaaggaaggtaagtggttggattaggttaggtgatatccaagtagaggtagccgaattctgtctaggactgggtcaatgatgacaacccaatgtcatgaagtaaggtgatgacataaaattcatgctcaataggattacgctgaggcccaaccagggtgacagggtcacaagaggtccgttgactccttggggggctcttgggtgacttccctgaagtcctcagatgcccttgccctgtttcccatgagaggaaatgtggacatctagggtgcacattggttggcaaacactgcatgccaacaaccacctagtcccacaatggaaccttgggcatttctgtaaggatcgccccttgctcatgacaatgtcttttctggtgttttgcagtcatctcacatgccaccttggaaggcagagaaacacagataatcaggtaagtggtcagaacctggtaaagcctccacatcaaggtgacctcccccttcatggtttggctttcaattctcagtcagtctgtccttttagaatttggggacaacaaaatggtatgcaacggtaccaaaggagctcgatttaggatatgttctcccatgtagatcccctggtttgtaaagttttaaggaatgtgttcaactcccgataattgtttttttaattttcacctacagctcatggagagaggaggatgacattttttgaatattgtgatctcatactttgatgcttacaattccatggaaaatagctacaggaggacaagacaggccctgagggctttatgggaggctttctttcccatgagaggggaggcccaagtaacagagcctttcttaggaaaaaagaaggattctatgatatccaaaaaggctgtcctccccaggatgggttcacaaagggcaatccctctagcagatattctaaagatctcaccccagagacaatttacccatgtggataggatgagatattcatttttaccttggtgcccaccatattccaaatttccttcatggtatcatttagggcacttaatgaacctcactgcagaatcactgaggaaaaaaagctctacacattaggttgatacagggtaaggccaggtgtttaaagaacctaattccactttgattcataacaccaaggcctgacttgagtccagcaacattggttaccctcatgttttacagcagggcaacccataacaccttgacacaaatggatccatgtatagacatgggttctgtggcctgggcccaggattctcaggacattttccggaatcacctttcatgttgagtccggtcgaacaacatagactttacagagttctgatgccacatttgcactttgagcaaaaacacacagttactttaatcaccctcgtaatacctatctgtagttgttttattcaattattttttgtcttatccatagaacttgggcagctcaacttgagtgttgatacctacaaaattgtgaggctaaggtcacatgtgatgtggctgttgcttcgagaggaagcagtaaatctttattggaatccagggttcctttgtgtgtccactgatgtttctctatggtagccaggaagacttgtgtgtcctggtttggtagtaatacaagaggtaaccccaggaaatattctgcacaatgaagttgtgccagtagagctccagaaaaatgtctctctcctctgacctttatttaaagaagggacaacaagcgccttgacttctttccctttcctccttagggaagacattcttccaagtatcaagaaaaggagcccttgcaaccctggaagacattttctcctagcaatccctctccagttccatatgaccattcctactctgagccagttttggaaaggagggtgagtggttggattaggttaggtgatatccaagtagaggtagccgaattctgtctaggactgggtcaatgatgacaacccaatgtcttgaagataggtgatgacataaaattcatgctcaataggattacgctgaggcccaaccagggtgacagggtcacaagaggtccattgactccttggagggctcttgggtgacttccctgaagtcctcaaatgctcttgccctgtttcccatgagaggaaatgtggacatgtagggtgcacattggttggcaaacactgcatgccaacaaccacctagtcccacaatggaaccatgggcatttttgtaaggatcgttccttgctcatgacaatgtcttttctggtgttttgcagtcatctcacatgccaccttggaaggcagagaaacacagataatcaggtaagtggtcagaacatggtaaagcctccacatccaggtgacctcccccttcatgttttggctttcaattctcagtcagtctgtccttttagaaattggggataacaaaatggtatgcatgctaccaaaggagctcgatttaggctatgttctcccatgtagatcccctggtatgtaaagttttaaggaatgtgttcaactccagataattgttttttcataattttgacctacttcttatggagagaggaggatgacattttttgaatgttgggatctcatactttgatgcttacaattccatgccaaatagctacaggaggacaacacaggcccccagggctttatgggactcttcctttcccgtgacaggggaggcccaagtgacagagcctttcttagggaaaaagaaggattctatgatatccaaaaaggctgtcctccccaggatgggttcacaaaggacaatccctctagcagatattccaaagatctcaccccagagacaatttacccatgtggatagggtgagatattcatttttaccttggtgcacactccatttaaaatttccttcatgtatcatttagggcacttactgagcctcactgtagaatcactgaggaaaaaaatctctacacattaggttgatacagggtaaggccaggtgtttaaagaacctaattccactttgattcataacaccaaggcctgacttgagtccagcaacagtggttaccctcacgttttacaaaagggcaacccataacaccttgacacaaatggatccatgtatagacatgtgttctgtggcctgggcccaggattctcaggagattttcaggaatcacctttcagcttgactctggtcgtacaacatagacctgacagaggtctgatgccatatttgcactttgagcaaaaacacacagttactttaatcaccctcgaaatacctaactgtagttgttttattcaattattttttttcctatccagagaacttgggcagctcaacttgagtgttgatacctacaaaattgtgaggctaaggtcacatgtgatgtggctgttgcttcgagaggaagcagtaaatctttattggaatccagggttcctttgtgtgtccactgatgtttctctatggtagccaggaagacttgtgtgtgataggctggtagtaatacaagaggtaaaaccaggacagttactgcacaaggaagttgtgccagtagagctccagaaaaatgtctctctcctctgacctttatttaaagaagggacaacaagcgccttgacttctttccctttcctccatagggaagacattcttccaaatatcaagaaagggagcccttgcttccctggaggacatttcgtcccagcaatccctctccatttccatgtgaccattcctactctgagccagttttggaaagaaaggtaagtggttggattaggttaggtgatatccaagtagaggtagctgaattctgtctaggactgggtcaatgatgacaacacaatgtcatgaagaaaggtgatgacataaaattcatgctcaataggattacgctgaggcccaaccagggcgacagggtcacaagaggtcagttgactcctttgggggctcttgggtgacttccctgaagtcctcagatgcccttgccctgtttcccatgagaggaaatgtggacatctagggtacacattggttggcaaacactgcatgccaacaagcacctagtcccacaatggaaccatgggcatttctgtaaggatggtcccttgctcatgacaatgtcttttctggtgttttgcagtcatctcacatgccaccttggaaggcagagaaacacagataatcaggtaagtggtcagaatatggtaaagcctcctcatccaggtgacctaacccttcatgttttggctttcaattctcagtcagtctgtccttttagaatttggggataaaaaaatggtatgcaatgctaccaaaggagctcgatttaggctatgttctcccatgtagatcccctggtttgtaaagttttaaggaatgtgttcaactcccgataattgtttttttaattttcacctacagctcatggagagaggaggatgacattttttgaatattgtgatctcatactttgatgcttacaattccatggaaaatagctacaggaggacaagacaggccctgagggctttatgggaggctttctttcccatgagaggggaggcccaagtaacagagcctttcttaggaaaaaagaaggattctatgatatccaaaaaggctgtcctccccaggatgggttcacaaagggcaatccctctagcagatattctaaagatctcaccccagagacaatttacccatgtggataggatgagatattcatttttaccttggtgcccaccatattccaaatttccttcatggtatcatttagggcacttaatgaacctcactgcagaatcactgaggaaaaaaagctctacacattaggttgatacagggtaaggccaggtgtttaaagaacctaattccactttgattcataacaccaaggcctgacttgagtccagcaacattggttaccctcatgttttacagcagggcaacccataacaccttgacacaaatggatccatgtatagacatgggttctgtggcctgggcccaggattctcaggacattttccggaatcacctttcatgttgagtccggtcgaacaacatagactttacagagttctgatgccacatttgcactttgagcaaaaacacacagttactttaatcaccctcgtaatacctatctgtagttgttttattcaattattttttgtcttatccatagaacttgggcagctcaacttgagtgttgatacctacaaaattgtgaggctaaggtcacatgtgatgtggctgttgcttcgagaggaagcagtaaatctttattggaatccagggttcctttgtgtgtccactgatgtttctctatggtagccaggaagacttgtgtgtcctggtttggtagtaatacaagaggtaaccccaggaaatattctgcacaatgaagttgtgccagtagagctccagaaaaatgtctctctcctctgacctttatttaaagaagggacaacaagcgccttgacttctttccctttcctccttagggaagacattcttccaagtatcaagaaaaggagcccttgcaaccctggaagacattttctcctagcaatccctctccagttccatatgaccattcctactctgagccagttttggaaaggagggtgagtggttggattaggttaggtgatatccaagtagaggtagccgaattctgtctaggactgggtcaatgatgacaacccaatgtcttgaagataggtgatgacataaaattcatgctcaataggattacgctgaggcccaaccagggtgacagggtcacaagaggtccattgactccttggagggctcttgggtgacttccctgaagtcctcaaatgctcttgccctgtttcccatgagaggaaatgtggacatgtagggtgcacattggttggcaaacactgcatgccaacaaccacctagtcccacaatggaaccatgggcatttttgtaaggatcgttccttgctcatgacaatgtcttttctggtgttttgcagtcatctcacatgccaccttggaaggcagagaaacacagataatcaggtaagtggtcagaacatggtaaagcctccacatccaggtgacctcccccttcatgttttggctttcaattctcagtcagtctgtccttttagaaattggggataacaaaatggtatgcatgctaccaaaggagctcgatttaggctatgttctcccatgtagatcccctggtatgtaaagttttaaggaatgtgttcaactccagataattgttttttcataattttgacctacttcttatggagagaggaggatgacattttttgaatgttgggatctcatactttgatgcttacaattccatgccaaatagctacaggaggacaacacaggcccccagggctttatgggactcttcctttcccgtgacaggggaggcccaagtgacagagcctttcttagggaaaaagaaggattctatgatatccaaaaaggctgtcctccccaggatgggttcacaaagggcaatccctctagcagatattccaaagatctcaccccagagacaatttacccatgtggatagggtgagatattcatttttaccttggtgcacactccatttaaaatttccttcatgtatcatttagggcacttactgagcctcactgtagaatcactgaggaaaaaaatctctacacattaggttgatacagggtaaggccaggtgtttaaagaacctaattccactttgattcataacaccaaggcctgacttgagtccagcaacagtggttaccctcacgttttacaaaagggcaacccataacaccttgacacaaatggatccatgtatagacatgtgttctgtggcctgggcccaggattctcaggagattttcaggaatcacctttcagcttgactctggtcgtacaacatagacctgacagaggtctgatgccatatttgcactttgagcaaaaacacacagttactttaatcaccctcgaaatacctaactgtagttgttttattcaattattttttttcctatccagagaacttgggcagctcaacttgagtgttgatacctacaaaattgtgaggctaaggtcacatgtgatgtggctgttgcttcgagaggaagcagtaaatctttattggaatccagggttcctttgtgtgtccactgatgtttctctatggtagccaggaagacttgtgtgtgataggctggtagtaatacaagaggtaaaaccaggacagttactgcacaaggaagttgtgccagtagagctccagaaaaatgtctctctcctctgacctttatttaaagaagggacaacaagcgccttgacttctttccctttcctccatagggaagacattcttccaaatatcaagaaagggagcccttgcttccctggaggacatttcgtcccagcaatccctctccatttccatgtgaccattcctactctgagccagttttggaaagaaaggtaagtggttggattaggttaggtgatatccaagtagaggtagctgaattctgtctaggactgggtcaatgatgacaacacaatgtcatgaagaaaggtgatgacataaaattcatgttcaataggattacgctgaggcccaaccagggcgacagggtcacaagaggtcagttgactcctttgggggctcttgggtgacttccctgaagtcctcagatgcccttgccctgtttcccatgagaggaaatgtggacatctagggtacacattggttggcaaacactgcatgccaacaagcacctagtcccacaatggaaccatgggcatttctgtaaggatggtcccttgctcatgacaatgtcttttctggtgttttgcagtcatctcacatgccaccttggaaggcagagaaacacagataatcaggtaagtggtcagaatatggtaaagcctcctcatccaggtgacctaacccttcatgttttggctttcaattctcagtcagtctgtccttttagaatttggggataaaaaaatggtatgcaatgctaccaaaggagctcgatttaggctatgttctcccatgtagatcccctggtatgtaaagttttaaggaatgtgttcaactcccgataattgttttttcataattttgaccttcttctcatggagagatgaggatgacatttcttgaatgttgggatctcatactttgatgcttacaattccatggcaaatagctacaggaggacaacacaggcccccagggctttatgggactcttcctttcctgtgacaggggaggtccaagtgacagagcctttcttagggaaaaagaaggattctatgatatccaaaaaggctgtcctccccaggatgggttcataaagggcaatccctctagcagatattccaaagatctcaccccagagacaatttacccatgtggatagggtgagatattcatttttaccttggtgcacactccatttaaaatttccttcatgtatcatttagggcacctattgaacctcactgtagaatcactgaggaaaaaaagctctacacattaggttgatacagggtaaggacaggtgtttaaagaacctaattccactttgattcataacaccaagtcctgacttgagtccagcaacaggggttaccctcacgttttacagcagggcaacccataacaccttgacacaaatggatccatgtatagacatgggttctgtggcctgggcccaggattctcgggagattttcaggaatcacctttcagcttgagtcggtcgtacaacatatacctgacagaggtctgatgccacatttgcactttgagcgaaaacacacagttactttaatcaccctcgaaatacctaactgtagttgttttattcagttattttttgtcctatccatagaacttgggcagctcaacttcagtattgatacctacaaaattgtgaggctaaggtcacatgtgatgtggctgttgtttcgagaggaagcattaaatctttattggaatccagggttcctttgtgtgtccactgatgtttctctatggtagccaggaagacttgtgtgtgataggctggtagtaatacaagaggtaaccccaggacagtttctgcacaaggaagttgtgccagtagagctccagaaaaatgtctctctcctctgacctttatttaaagaagggacaacaagcgtcttgacttctttccctttcctccttagggaagacattcttccaagtatcaagaaagggagcccttgcttccctggaggacatttcgtcccagcgatccctctccatttccatgtgaccattcctactctgagccagttttggaaaggaaggtaagtggttggattaggttaggtgatatccaagtagaggtagccgaattctgtcttggactgggtcaatgatgacaacacaatgtcatgaagaaaggtgatgacataaaattcatgctcaataggattacgctgaggcccaaccagtgcgacagggtcacaagaggtccgttgactctttggggggctcttaggtgacatccctgaagtcctcagatgtccttgccctgtttcccatgagaggaaatgtggacatctagggtacacattggttggcaaacactgcatgccaacaagcacctagtcccacaatggaaccatgggcatttctgtaaggatcatcccttgctcatgacaatgtcttttctggtgttttgcagtcatctcacatgccaccttggaaggcagagaaacacagataatcaggtaagtggtcagaacatggtaaagcctccacatccaggtgacctcccccttcatgttttggctttcaattctcagtcagtctgtccttttagaatttggggataacaaaatggtatgcaatgctaccaaaggagctcgatttaggctatgttctcccatatagatcccctggtatgtaaagttttaaggaatgtgttcaactcccgataattgttttttcataattttgaccttcttctcatggagagaggaggatgacattttttgaatattgggatctcatactttgatgcttacaattccatggcaaatagctacaggaggtcaacacaggcccccagggctttatgggactcttcctttcccgtgacaggggaggcccaagtgacagagactttcttagggaaaaagaaggattctatgatatccaaaaaggctgtcctccccaggatgggttcacaaaaggcaatccctctagcagatattccaaagatctcacccaagagacaatttagccatgtggatagggtgagatattcatttttaccttggtgcccaccacatttaaaatttccttcatgtatcatttagggcacttactgaacctcactgcagaatcactgaggaaaaaaagctctacacattaggttgatacagggtaaggccaggtgtttaaaggacctaattccactttgattcataacaccaagtcctgacttgagtccagcaacagtggttaccctcacgttttacctcagggcaaccaataacaccttgacacaaatgcatccatgtataaacatgggttctgtggcctgggcccaggattctcgggatattttcaggaatcacctttcaggttgagtctggtcgtccaacatatacctgacagaggtctgatgccacatttgcactttgagcaaaaacacacagttactttaatcaccctggaaatacctaactctagttgtcttattcaattatgttttgtcctatccatagaacttgggcaactcaacttgaatgttgatacctacaaaattgtgaggctaaggtcacatgtaatgtggctgttgcttcgagaggaagcagtaaatctttattggaatccagggttcctttgtgtgtccactgatgattctctatggtagccaggaagacttttgtgtgctgggctggtagtaatacaagaggtaacccctggacagtttctgcacaatgaatttgtgccagtagacctccagaaaaatgtctctctcctctgacctttatttaaagaagggacaacaagcgccttgacttcattccctttcctcctttgggaagacattcttccaagtatcaagaaagggagccctagcttccctggaggacatttcgtcccagcgatccctctccatttccatgtgaccattcctactctgagccagttttggaaaggaaggtaagtggttggattaggttaggtgatatccaagtagaggtagccgaattctgtcttggactgggtcaatgatgacaacacaatgtcatgaagaaaggtgatgacataaaagtcatgctcaataggattacgctgaggcccaaccagggcgacagggtcacaagaggtccgttgactctttggggggctcttaggtgacatccctgaagtcctcagatgtccttgccctgtttcccatgagaggaaatgtggacatctagggtacacattggttggcaaacactgcatgccaacaagcacctagtcccacaatggaaccatgggcatttctgtaaggatcatcccttgctcatgacaatgtcttttctggtgttttgcagtcatctcacatgccaccttggaaggcagagaaacacagataatcaggtaagtggtcagaacatggtaaagcctccacatccaggtgacctcccccttcatgttttggctttcaattctcagtcagtctgtccttttagaatttggggataacaaaatggtatgcaatgctaccaaaggagctcgatttaggctatgttctcccatgtagatcccctggtatgtaaagttttaaggaatgtgttcaactcccgataattgttttttcataattttgaccttcttctcatggagagaggaggatgacattttttgaatattgggatctcatactttgatgcttacaattccatggcaaatagctacaggaggtcaacacaggcccccagggctttatgggactcttcctttcccgtgacaggggaggcccaagtgacagagactttcttagggaaaaagaaggattctatgatatccaaaaaggctgtcctccccaggatgggttcacaaaaggcaatccctctagcagatattccaaagatctcacccaagagacaatttagccatgtggatagggtgagatattcatttttaccttggtgcccaccacatttaaaatttccttcatgtatcatttagggcacttactgaacctcactgcagaatcactgaggaaaaaaagctctacacattaggttgatacagggtaaggccaggtgtttaaaggacctaattccactttgattcataacaccaagtcctgacttgagtccagcaacagtggttaccctcacgttttacctcagggcaaccaataacaccttgacacaaatgcatccatgtataaacatgggttctgtggcctgggcccaggattctcgggatattttcaggaatcacctttcaggttgagtctggtcgtccaacatatacctgacagaggtctgatgccacatttgcactttgagcaaaaacacacagttactttaatcaccctggaaatacctaactctagttgtcttattcaattatgttttgtcctatccatagaacttgggcaactcaacttgaatgttgatacctacaaaattgtgaggctaaggtcacatgtaatgtggctgttgcttcgagaggaagcagtaaatctttattggaatccagggttcctttgtgtgtccactgatgattctctatggtagccaggaagacttttgtgtgctgggctggtagtaatacaagaggtaacccctggacagtttctgcacaatgaatttgtgccagtagagctccagaaaaatgtctctctcctctgacctttatttaaagaagggacaacaagcgccttgacttcattccctttcctcctttgggaagacattcttccaagtatcaagaaagggagccctagcttccctggaggacatttcgtcccagcgatccctctccatttccatgtgaccattcctactctgagccagttttggaaaggaaggtaagtggttggattaggttaggtgatatccaagtagaggtagccgaattctgtcttggactgggtcaatgatgacaacacaatgtcatgaagaaaggtgatgacataaaattcatgctcaataggattacgctgaggcccaaccagggcgacagggtcacaagaggtccgttgactctttggggggctcttaggtgacatctctgaagtcctcagatgtccttgccctgtttcccatgagaggaaatgtggacatctagggtacacattggttggcaaacactgcatgccaacaagcacctagtcccacaatggaaccatgggcatttctgtaaggatcatcccttgctcatgacaatgtcttttctggtgttttgcagtcatctcacatgccacattggaaggcagagaaacacagataatcaggtaagtggtcagaacatggtaaagcctccacatccaggtgacctcccccttcatgttttggctttcaattctcagtcagtctgcccttttagaatttggggataacaaaatggtatgtaatgctaccaaaggagctcgatttaggctatgttctcccatgtagatcccctggtatgtaaagttttaaggaatgtgttcaactcccgataattgttttttcataattttgaccttcttctcatggagagaggaggatgacattttttgaatattgggatctcatactttgatgcttacaattccatggcaaatagctacaggaggtcaacacaggcccccagggctttatgggactcttcctttcccgtgacaggggaggcccaagtgacagagactttcttagggaaaaagaaggattctataatatccaaaaaggctgtcctccccaggatgggttcacaaaaggcaatccctctagcagatattccaaagatctcacccaagagacaatttagccatgtggatagggtgagatattcatttttaccttggtgcccaccacatttaaaatttccttcatgtatcatttagggcacttactgaacctcactgcagaatcactgaggaaaaaaagctctacacattaggttgatacagggtaaggccaggtgtttaaaggacctaattccactttgattcataacaccaagtcctgacttgagtccagcaacagtggttaccctcacgttttacctcagggcaaccaataacaccttgacacaaatgcatccatgtataaacatgggttctgtggcctgggcccaggattctcgggatattttcaggaatcacctttcaggttgagtctggtcgtccaacatagacctgacagaggtctgatgccacatttgcactttgagcaaaaacacacagttactttaatcaccctggaaatacctaactctagttgtcttattcaattatgttttgtcctatccatagaacttgggcaactcaacttgaatgttgatacctacaaaattgtgaggctaaggtcacatgtaatgtggctgttgcttcgagaggaagcagtaaatctttattggaatccagggttcctttgtgtgtccactgatgattctctatggtagccaggaagacttttgtgtgctgggctggtagtaatacaagaggtaacccctggacagtttctgcacaatgaatttgtgccagtagagctccagaaaaatgtctctctcctctgacctttatttaaagaagggacaacaagcgccttgacttcattccctttcctcctttgggaagacattcttccaagtatcaagaaagggagccctagcttccctggaggacatttcgtcccagcaatccctctccatttccatgtgaccattcctactctgagccagttttggaaaggaaggtaagtggttggattaggttaggtgatatccaagtagaggtagctgaattctgtctaggactgggtcaatgatgacaacacaatgtcatgaagaatggtgatgacataaaattcatgctcaataggattacgctgaggcccaaccagggcaacagggtcacaagaggtccgttgactcctttgggggctcttgggtgacttccctgaagtcctcagatgcccttgccctgtttcccatgagaggaaatgtggacatctagggtacacattggttggcaaacactgcatgccaacaagcacctagtcccacaatggaaccatgggcatttctgtaaggatcgtcccttgctcatgacaatgtcttttctggtgttttgcagtcatctcacatgccaccttggaaagcagagaaacacagataatcaggtaagtggtcagaacatggtaaagcctccacatccaggtgacctaccccttcatgttttggctttcaattctcagtcagtctgtccttttagaatttggggataacaaaatggtatgcaatgctaccaaaggagctcgatttaggctatgttctcccaagtagatcccctggtatgtaaagttttaaggaatgtgttcaactcccgataattgttttttcataattttgaccttcttctcatggagagaggaggatgacatttcttgaatgttgggatctcatactttgatgcttataattccatggcaaatagctacaggaggacaacacaggcccccagggctttatgggacttttcctttcccgtgacaggggaggcccaagtgacagagcctttcttagagaaaaagaaggactctatgatatccaaaaaggctgtcctccccaggatgggttcacaaagggcaatccctctagcagatattccaaagatctcacccaagagacaatttacccatgtggatagggtgagatattcatttttaccttggtgcccaccacattccaaatttccttcatggtatcatttagggcacttactgaacctcactgcagaatcactgaggaaaaaaagctctacacattaggttgatacagggtaaggccaggtgtttaaagaacctaattccactttgattcataacatcaaggcctgacttgagtccaacaacagtggttaccctcacgttttacagcagggcaacccataactcctttacacaaatggatccatgtaatgacattggttctgtggcctgggcccaggattctcaggagattttcaggaatcacctttcaggttgagtctggtcgtccaacatagacctgacagaggtctgatgccacatttgcactttgagcaaaaacacagttacgttaatcaccctcgaaatacctaactgtagttgttttattcaattatttttgtcctatccatagaacttgggcagctcaacttgagggttgatacctaaaaattgtgaggctaaggtcacatgtgatgtggctgttgctttgagaggaagcagtaaaactttattagaataccagggttcctttgtgtgtcctctgatgtttctctatggtagtcaggaagacttgtgtttgctgggctggtagtaatacaagaggaaaccccaggacagtttctgcacaatgaagttgtgccagtagagctccagaaaaatgtctctctcctctgacctttatttaaagaagggacaacaagcgccttgacttctttccctttcctccttagggaagacattcttccaagtatcaagaaagggagcccttgcttccctggaagacatttcgtcagagcaatccctccccagttccgtgtgaactttcctactctgagccagttttggaaaggaaggtaagtggttggattaggttaggtgatatccaagtagaggtagctgaattctgtctaggactggatcaatgatgacaaaccaatgtcatgaagaaatgtgatgacataaaatttatgctcaataggattacgctgaggcccaaccagggtgacagggtcacaaaaggaccattgactcctagggaggggctcttgggtgacttccctgaagtcctcagatgcccttgccctgtttcccatgagaggaaatgtggacatctatggtgcacattggtttgcaaacactgcatggcaacaagcacctagtcccacaatggaaacatgggcatttctgcaaggatcgccccttgctcgtgacaatgtcttttctggtgttttgcagtcatctcacatgccaccttggaagtcagagaaacacagataatcaggtaagtggtcagaacatggtaaagcctccacatccaggtgacctcccccttcatggtttggctttcaattctcagccagtctgtccttttggaatttggggataacaaaatggtatgcaatggtaccaaaggagctcatttaggctatgttatcccatgtagatcctctggtttgtaaagttttaaggaatgtgatcaactcctgataattgttttttcataattttgacctacttctcatggagaggaggatgaaattttttaatgtttagatctcatactttgatgcttacatttccatggcaaatagctacaggaggtcaacacaggcctccagggacttattggacacttcctctctcttgactgtaaggcccaagtgacagaacctttcttagggaaaaagaaggattctatgatatccaaagaggctgtcctccccaggatgggttcaaaaagggcaatccctctagcagatattccaaagatctcaccccagagacaatttatccatgtgggtaggttgagatattcatttttaacttggtgcccaccacattccaaatttccttcatggtatcatttgggcacttactgaacctcactacagaatcactgaggaaaaatatctctacacattaggttgatacagggtaaggccaggtgtttaaagaacctatttccactttcattcataacaccaaggcctgactagagtccagcaacagtggttaccctgacgttttacagcagggcaacccataacttcttgacacaaatggatccatttatggacattggttctgtcgtctggcccaggattctcaggagattttcaggaataacctttcacgttgagtggggtcttacaacatagaccttacagaggtctgatgccacaattgcactttgagcaaaaacacacagttactttaatcaccctcgaaatacctatctgtagttgttttatttaattatttttcttcgtcctatccatagaaattgggcagttcaacttgagtattgatacctacaaaattgtgaggctaaggtctcatgtgatgtggctgttgcttagagaggaagcagtaatctttattggaatccagggttcctttgtgtgtccactgatgtttctctatcgtagccaggaagacttgtgtgtgctgggctggtagtaatacaagaggtacccccaggacagtttctgcacaatgaagttgtgccagtagagctccagaaaaatgactctcccctctgacctttacttaaagaagggacaacaagcgccttgacttctttccatttcctccttagggaagacattcttccaagtatcaagaaagggagcccttgcttccctggaagatattacgtcccagcaattcctctccagttccatgtgaccattcctactctgaaccagtttttgaaaggaaggtaagtagttggattaggttaggtgatatccaagtagaagtagccgaattctgtctaggtctgggtcaatggtgacaacccaatgtcatgaagaaagttgatgacataaaattcatgctcaataggattatgctgaggcccaaccagtgcgacagggtcaaaagaggtcagttgactccttggggggggctcttgggtgacttccctgaagtcctcagatgccctttccctgtttcccatgagaggaaatgtggacatctagggtgcactttcgttggcaaacactgcatgccaacaaacacctagtcccacaatggaaccttgggcatttctgcaaaggtcgtcccttggccatgacaatgccttttctggtgttttgcagtcatctcacatgccaccttggaaggcagagaaatacagataatcaggtaagtggtcagaacatggtaaagcctccacatccaggtgacctcccccttcatgttttggctttcaattctcagccaggctgtccttttagaatttggggataacaaatttatgaaacagtacaaaaggagctcgatttaggatatgttctcccatgtagatcccctagtttgtaaagttttaaggaatgtgttcagctcccgataattgttttttcataattttgacctacttctcatggagagaggaggatgacatttcttgaatgttgggatctcatactttgatgcttacaattccattggaaaaagctacaggaggacaacacaggcctccagggccttatgggacttttcctttcccgtgacaggggaggcccaagtgacagagcctttcttagggaaaaagaaggattctatgatatccaaaaaggctgtcctccccaggatgggttcacaaagggcaatccctctagcagatattccaaagatctcacccaagagacaatttacccatgtggatagggtgagatattcatttttaccttggtgcccaccacattccaaatttaattcatggtatcctttagggcacttactgaacctcactgcagaatcactgaggaaaaaaagctctacacattaggttgatacagggtaaggccaggtgtttaaagaacctaattccactttgattcataacaccaaggcctgacttgagtccagcaaaagtggttaccctcacattttacagcagggcaacccataacaccttgacacaaatggatccatgtatagacatgggttctgtggcctgggcccaggattcttgggagattttcaggaatcacctttcaggttgagtctggtcgtacaacatagacctgacagaggtctgatgccacatttgcactttgagcaaaaacacacagttactttaatcaccctcgaaatacctaactgtagttgttttattcaattatttttgtcctatccatagaacttgggcagctcaacttgagggttgatacctaaaaattgtgaggctaaggtcacatgtgatgtggctgttgcttcgagaggaagcagtaaaactttattagaataccagggttcctttgtgtgtcctctgatgtttctctatggtagccaggaagacttgtgtttgctgggctggttgtaatacaagaggaaaccccaggacagtttctgcacaatgaagttgtgccagtagagctccagaaaaatgtctctctcctctgacctttatttaaagaagggacaacaagcgccttgacttctttccctttcctccttagggaagacattcttccaagtatcaagaaagggagcacttgcttccctggaagacatttcgtcagagcaatccctccccagttccatgtgaactttcctactctgagccagttttggaaaggaaggtaagtggttggattaggttaggtgatatccaagtagaggtagcccaattctgtctaggactggatcaatgatgacaaaccaatgtcatgaagaaatgtgatgacataaaatttatgctcaataggattacgctgaggcccaaccagggtgacagggtcacaaaaggaccattgactcctagggaggggctcttgggtgacttccctgaagtcctcagatgcccttgccctgtttcccatgagaggaaatgtggacttctatggtgcacattggtttgcaaacactgcatggcaacaagcacctagtcccacaatggaaacatgggcatttctgcaaggatcgccccttgctcgtgacaatgtcttttctggtgttttgcagtcatctcacatgccaccttggaagtcagagaaacacagataatcaggtaagtggtcagaacatggtaaagcctccacatccaggtgacctcccccttcatggtttggctttcaattctcagccagtctgtccttttggaatttggggataacaaaatggtatacaacggtaccaaaggagctcatttaggctatgttatcccatgtagatcctctggtttgtaaagttttaaggaatgtgatcaactcctgataattgttttttcataattttgacctacttctcatggagaggaggatgaaattttttaatgtttagatctcatactttgatgcttacatttccatggcaaatagctacaggaggtcaacacaggcctccagggacttattggacacttcctctctcttgactgtaaggcccaagtgacagaacctttcttagggaaaaagaaggattctatgatatccaaagaggctgtactccccaggatgggttcaaaaagggcaatccctctagcagatattccaaagatctcaccccagagacaatttatccatgtgtataggttgagatattcatttttaacttggtgcccaccacatttaaaatttccttcatggtatcatttgggcacttactgaacctcactgcagaatcactgaggaaaaatatctctacacattaggttgatacagggtaaggccaggtgtttaaagaacctatttccactttcattcataacaccaaggcctgactagagtccagcaacagtggttaccctgacgttttacagcagggcaacccataacttcttgacacaaatggatccatttatggacattggttctgtcgtctggcccaggattctcaggagattttcaggaatcacctttcacgttgagtggggtcttacaacatagaccttacagaggtctgatgccacaattgcactttgagcaaaaacacacagttactttaatcaccctcgaaatacctatctgtagttgttttatttaattattttttttcgtcctatccatagaaattgggcagttcaacttgagtgttgatacctacaaaattgtgaggctaaggtctcatgtgatgtggctgttgcttagagaggaagcagtaatctttattggaatgccagggttcctttgtgtgtccactgatgtttctctatcgtagccaggaagacttgtgtgtgctgggctggtagtaatacaagaggtacccccaggacagtttctgcacaatgaagttgtgccagtagagctccagaaaaatggctctcccttctgacctttacttaaagaagtgacaacaagcgccttgacttctttccatttcctccttagggaagacattcttccaagtatcaagaaagggagcccttgcttccctggaagacattacatcccagcaattcctctccagttccatgtgaccattcctactctgaaccagtttttgaaaggaaggtaagtagttggattaggttaggtgatatccaagtagaagtagacgaattctgtctaggtctgggtcaatggtgacaacccaatgtcatgaagaaagttgatgacataaaattcatgctcaataggattacgctgaggcccaaccagtgcgacagggtcaaaagaggtcagttgactccttgggggggctcttggatgacttccctgaagtcctcagatgccctttccctgtttcccatgagaggaaatgtggacatctagggtgcacattggttggcaaacactgcatgccaacaaacacctagtcccacaatggaaccttgggcatttctgcaaaggtcgccccttggccatgacaatgccttttctggtgttttgcagtcatctcacatgccaccttggaacgcagagaaatacagataatcaggtaagtggtcagaacatgataaagcctccacatccaggtgacctcacactctttggtttggctttcaattctcagccaggctttccttttggaatttggggataacaaatttacgcaacagtacaaaaggagctcgatttaggatatgttctcccatgtagatcccctagtttgtaaagatttaaggaatgtgttaagctcccgataattgttttttcataattttgacctacttctcatggagagaggaggatgacattttttaatgtttagatctcatactttgatgcttacatttccatggcaaatagctacaggaggtcaacacaggcctccagggacttattggacacttcctctctcttgactgtaaggcccaagtgacagagcctttcttagggaaaaagaaggattctatgatatccaaagaggctgtcctccccaggatgggttcaaaaagggcaatccctctagcagatattccaaagatctcaccccagagacaatttatccatgtggatagggtgagatattcatttttaacttggtgcccaccacattccaaatttccttcatggtatcatttgggcacttactgaacctcactgcagaatcactgaggaaaaatatctctacacattaggttgatacagggtaaggccaggtgtttaaagaacctaattccactttcattcataacaccaaggcctgacttgagtccagcaacagtggttacactgacgttttacagcagggcaacccataactccttgacacaaatggatccatttatggacattggttctgtcgtctggcccaggattctcaggagattttcaggaatcacctttcacgttgagtggggtcttacaacatagaccttacagaggtctgatgccacaattgcactttgagcaaaaacacacagtttctttaatcaccctcgaaatacctatctgtagttgttttatttaattattttttttcgtcctatccatagaaattgggcagctcaacttgagtgttgatacctacaaaattgtgaggctaaggtctcatgtgatgtggctgttgcttagagaggaagcagtaatctttattggaatgccagggttcctttgtgtgtccactgatgtttctctatggtagccaggaagacttgtgtgtgctgggctggtagtaatacaataggtacccccaggacagtttctgcacaatgaagttgaaccagtagagctccagaaaaatgactctcccctctgacctttacttaaagaagtgacaacaagcgccttgacttctttccatttcctccttagggaagacattcttccaagtatcaagaaagggagcccttgcttccctggaagacattacatcccagcaattcctcaccagttccatgtgaccattcctactctgaaccagtttttgaaaggaaggtaagtagttggattaggttaggtgatatccaagtagaatgagccgaattctgtctaggtctgggtcaatggtgacaacccaatgtcatgaagaaagttgatgacataaaattcatgctcaataggattacgctgaggcccaaccagtgcgacagggtcaaaagaggtcagttgactccttgggggggctcttggatgacttccctgaagtcctcagatgccctttccctgtttcccatgagaggaaatgtggacatctagggtgcacattggttggcaaacactgcatgccaacaaacacctagtcccacaatggaaccttgggcatttctgcaaatgtcgccccttggccatgacaatgccttttctggtgttttgcagtcatctcacatgccaccttggaacgcagagaaatacagataatcaggtaagtggtcagaacatggtaaagcctccacatccaggtgacctcacactctttggtttggctttcaattctcagccaggctttccttttggaatttggggataacaaatttacgcaacagtacaaaaggagctcgatttaggatatgttctcccatgtagatcccctagtttgtaaagatttaaggaatgtgttaagctcccgataattgttttttcataattttgacctacttctcatggagagaggaggatgacattttttaatgtttagatctcatactttgatgcttacatttccatggcaaatagctacaggaggtcaacacaggcctccagggacttattggacacttcctctctcttgactgtaaggcccaagtgacagagcctttcttagggaaaaagaaggattctatgatatccaaagaggctgtcctccccaggatgggttcaaaaagggcaatccctctagcagatattccaaagatctcaccccagagacaatttatccatttggatagggtgagatattcatttttaacttggtgcccaccacattccaaatttccttcatggtatcatttgggcacttactgaacctcactgcagaatcactgaggaaaaatatctctacacattaggttgatacagggtaaggccaggtgtttaaagaacctaattccactttcattcataacaccaaggcctgacttgagtccagcaacagtggttacactgacgttttacagcagggcaacccataactccttgacacaaatggatccatttatggacattggttctgtcgtctggcccaggattctcaggagattttcaggaatcacctttcacgttgagtggggtcttacaacatagaccttacagaggtctgatgccacaattgcactttgagcaaaaacacacagtttctttaatcaccctcgaaatacctatctgtagttgttttatttaattattttttttcgtcctatccatagaaattgggcagctcaacttgagtgttgatacctacaaaattgtgaggctaaggtctcatgtgatgtggctgttgcttagagaggaagcagtaatctttattggaatgccagggttcctttgtgtgtccactgatgtttctctatggtagccaggaagacttgtgtgtgctgggctggtagtagtacaagaggtaaccccaggacagtttctgcacaatgaacttgtgccagtagagctccagaaaaatgactctcccctctgaactttatttaaaaaagggactacaagcgccttgacttctttcccttttctccttagggaagacattcttccaagtatcaagaaagggagcccttgcttcctgggaagacatttcgtcccagcaatccctctccagttccatgtgaccattcctactctgagccagttttggaaaggaaggtaagtggttggattaggttaggtgatatccaagtagaggttcccgaattctgcctagaactgggccaatgatgacaaccaaatgtcatgaagaaatgtgatgacataaaattcatgctcaataggattacgctgaggtccaaccagggcaacagggtcacaagaggtcccttgactccttggggggctcttgggtgacttccctgaagtcctcagatgcccttgccctgtttcccatgagaggaaatgtggacatctatggtgcacattcgttggcaaacactgcatgccaacaagcacctatcccacaatggaaccttgagcatttctgcaaggatcgccccttgctcatgacaatgtcttttctggttttttgcagtcatctcacatgccacctaggaaggcagagaaacacagataatcaggtaagtggtcagaacatggtaaagcctccacatccaggtgacctcccccttcatgatttggctttcaattctcagccagtctgaccttttgggttttggggataccaaaatggtatgcaacggtaccaaaggagctcgatttaggctatgttctccaatgtagatcccctggtatgtaaagttttaaggaatgtgttcaactcccgataattgttttttcataattttgacctacttctcatggagagaggaggatgacattttttgaatgttgggatctcatactttgatgcttacaattccatggcaaatagctacaggaggacaacacaggcccccagggctttatgggacttttcctttcccttgacaggggaggcccaagtgacagagcctttcttagggaaaaagaaggatctataatatccaaaaagactgtccttcccaggataggttcacaaagtacaatccctctagcagatattcgaaagatttcaccccagagacaatttacccatgtggatagggtgagatattcgtttttaccttggtggccaccacattccaaatttccttcatggtatcattcagggcacttactgaacctcactgcagaatcactgaggaaaaaaagctctacacattaggtttatacagggtaaggccaggtgtttaaaggacctaattccactttgattcataacaccaaggcctgacttgagtccagcaacagtggttaccctcatgttttacagcagggcaacccataaaaacttgacacaaatggatccatgtatagacattggttctgtggcctgggcccaggattctcaggaaattttcaggaatcacctttcacgttgagtggggttgtacaacatagaccttacaaaggtctgatgacacatttacaccttgagccagaacccacagatactttaatcaccctcgaaatacctatctgtagttgttttatttaattatttttttttttttgttctatccatagaacttggtgaattcaactttgtgttgatccctaaaaattgtgaggctaaggtcacatgtgatgtggctgttgctttgagaggaagcagtaaaattttattggaataccagggttcctttgtgtgtccactgatgtttctctaaggtagccaggaagacttgtgtttgctgggctggtagtaatacaagaggaaacccaggacagtttctgcacaatgaagttgtgccagtagagctcctgaaaaatgtctctctcctctgacctttatttaaagaagggacaacaagcgccttgacttctttccctttcctccttagggaagacattcttccaagtatcaagaaagggagcccttgcttccctggaagacatttcgtcagagcaatccctccccaattccgtgtgaactttcctactcggagccagttttggaaaggaaggtaagtggttggattaggttaggtgatatccaagtagaggtagccgaaatctgtctaggactgggtcaatgatgacaaactgatgtcatgaagaaatgtgatgacataaaatttatgctcaataggattacgctgaggcccatccatggtcacagggtcacatgaggaccattgactccatggggtggctcttgtgtgacttccctgaagtcctcagatgcccttgccctgtttcccatgagaggaaatgtggacatctatggtgcacattggtttgcaaacactgcatggcaacatgcacctagtcccacaatggaaccttgggcatttctgcaaggatcgccccttgctcatgacaatgtcttttctggtgttttgcagtcatctcacatgccaccttggaaggcagagaaacacagataatcaggtaagtggtcagaacatggtaaagcctccacatccaggtgacctcccccttcatggtttggctttcaattctcagccagtctgtccttttggaatttggggataccaaaatggtatgcaacggtaccaaaggagctcgatttaggctatgttatcccatgtagatcctctggtttgtaaagttttaaggaatgtgatcaactcccgataattgttttttcataattttgacctacttctcatggagagaggaggatgacattttttgaatgttgggatctcatactttgatgcttacatttccatggcaaatagctacaggaggtcaacacaggcctccagggccttattggacacttcctttcccttcacactaaggcccaagtgacagaacctttcttagggaaaaagaaggattctatgatatccaaagaggctgtcctccccaggatgggttcaaaaagggcaacccctctagcagatattccaaagatctcaccccagagccaatttacccatgtggatagggtgagatattcatttttaccttggtgcccaccacattccaaatttccttcatagtgtcatttagggcacttactgaacctcactgcagaatctctgaggaaaaaaacctctacacattaggttgatacagggtaagtccaggtgtttaaagaacctaattccactttgattcataacaccaaggcctgacttgagtccaacaacagtggttaccctcacgttttacagcagggcaacccataactcctttacacaaatggatccatgtaatgacattggttctgtggcctgggcccaggattctcaggagattttcaggaatcacctttcacgttgagtggggtcgtacaacatagaccttacagaggtttgatgacacatttacactttgagcaagaacccacagatactttaatcaccctcgaaatacctatctgtagttgttttatttaattattttttttgtcctatccatagaactaggtcagctcaacttgattgttgatctctacaaaattgtgaggctaaggtcacatgtgatgtggctgttgcttcaagaggaagcagtaaatctttattggaatccagggttcctttgtgtgtccactgatgtttctctatggtagccaggaagacttgtgtgtgctgggctggtagtaatacaagaggtaaccccaggacagtttctgcacaatgaagttgttccagtagagctccagaaaaatgtctctctcctctgacctttatttaaagaagggacaacaagcgccttgacttctttccctttcctccttagggaagacattcttccaagtatcaagaaagggagcccttgcttccctggaagacatttcgtcagagcaatttctccccagttccgtgtgaccattcatactctgagccagttttggaaaggaaggtaagtggttggattaggttaggtgatatccaagtagaggtagccgaattctgtctaggactgggtcaatgatgacaacccaatgtcatgaagaaatgtgatgacataaaatttatgctcaataggattacgctgagtcccaaccagggtgacagggtcaaaagaggtccattgactccttggggggctcttgaagtcctcagatgcccttgccctgtttcccatgagaggaaatgtggacatctagggtgcacattggtttgcaaacactgcatgccaacaagcacctagtcccacaatggaaccatgggcatttctgcaaggatcgccccttgctcatgacaatgtcttttttggtgttttgcagtcatctcacatgccaccttggaaggcagagaaacacagataatcaggtaagtggtcagaacatggtaaagcctccacatccaggtgacctcccccttcatggtttggctttcaattctcagccagtctgtttttttggaatttggggataacaaaatggtatgcaatggtaccaaaggagctcgatttaggctatgttctcccatgtagatcccctggtttgtaaagttttaaggaatgtgttcaactaccgataattgttttttcataattttgacatacttctcatggagagaggaggatttcatttcttaatgttgagatctcatactttgatgcttacatttccatggcaaatagctacaggaggtcaacactggcctccagggacttatgggacacttcctttcccttgacagggaggcccaagtgacagagcctttcttagggaaaaagaaggaatctatgatatccaaaaaggctgtcctccccaggatgggttcacaaagggcaatccctctagcagatattccaaagatctcaccccagagacaatttacccatgtggattgggtgagatattcgtttttaccttggtggccaccacattccaaatttccttcatggtatcatttagggcacttactgaacctcactggagaatcactgaggaaaaaaagctctacacattaggttgatacagggtaaggccaggtttttaaagaacctaattccactttcattcataataccaaggcctgacttaagtccagcaactgtgcttaccctcctgttttacagcagtgcaactcataacaccttgaaacaaatggatttatgtatagacattgtttctgtggcctgggcccaggattctcgggagattttcaggaatcacctttcacattgagtggtgttgtgcaacctagaccttatagagttctgatgacacatttacaccttgagccagaacccacagatactttaatcatcctcgaaatacctatctgtagttgttttatttaattatttttttgtcctatctatagaacttcggcagcacaacttgagtgttgatcccaaaaaatcgttgggctaaggtcacatgtgatgtggctggtgcttcaagaggaagaagtaaatcattattggaatgccagggttcctttgggcttccacagatatttctctatggtagccgggaagacttttgtgtgctgggctggtagtaatacaagaggcaaccacaggacagtttctgcacaatgaagttgtgccattagagctccagaaaaatgtctctaccctctgacctttatttaagaagggacaacaggtgccttgacttctttccctttcctccttagggaagacattcttccaagtatcaagaaagggagcccttgcttccctggaagacatttcgtccctgcatccctcttacgttccatatgatcattcctactctgaggcagttttaaaaaggaaggaaagtggttggattaggttagctgatatccaagtacagctaactgtatcctgtctaggcctgggtcaataatggcaatccaatgtcatgaagaaaggtgatgacataaaattcatgctcaataggattactctgaggcccaaccagggcgacagggtcacaagaggtctgttgactccttgggggggctcttgggtgacttccctgatgtcctcagatgcccttgccctgttttccatgagaggaaatgtggaaataggtacaggtggaaaacacaggcctccatggccttatgggactcttcctttcccttgacattggaggcccaagggacagagcctttcttagggagaaagaaagattctatggtatccaaaaaggttgtcctccacatggtgggttcacaaagtgcaatccctcgagccaatgtcatgaagaaaggtgatgacataaaattcatgctcaataggattatgctgaggcccaaccctggagacagggtcacaagaggtccgttgactccttggtgggctcttggttgacttcctttaggtcctcagatgcccttgccctgtttcccatgagaggaatgtacatgtgaagagaggtgatgtcatatgattcatgctcaataggattatactgaggccctaccacggagacaggtttacaagaggtctgttgactctctggagtgctcttggatgacttccttgtagtcctcagatgccactaccctgtttctcatgagaagaaatgtggatatctagggtgcacattggtttgcaaacactctatgccaacaagcacctaatcctacaatggaaccttggttatttctgcatagaagaccattcgctcatttccctgtcttttctggtgttttgtagtcatctcacatgccaccttggaaggcagagaactgcagataatcaggttagtgttaagaacatggtaaagcctccacctctaggtgacctgccccttatgttttggctttcaattctgagccaccctgcccttttggaatttgggaatagcaaaatcctatgcaatggtaggcaatgaagctggatttatgctatgttctcccaggtagtccccctggtttgtaaaggtttaagaaatgcattcaattcccaataattattttctcataatttcgacctacttctcatggggagaagaggatgacatttttaggatgttgggatctcatactttggtacttacaaggccatggtgaatagttacaggaggacaatgcaagctcccaggcccatatatgaggcttactttcccatgacataggaggcctaagacacagaacctttcttactgagagaggaggattctatgatatcctacaaggctggcctccacatgatgtgttcacaaagggcaaaccctcaagcaattattgcaaagatatcactccagagggaatttactcatgtgtactgggtgtgattttcatttttacgtttgttccctccatcttccaaatttccttcatggtatcatttaaggcacttactaaacctcactgtagaatcactgaggaaacaaaggcctacacatttggttgaaacagggaaggcccaggtgtttaaagaacctaattccactctgattcataacaccaaggcctgacttgaatccagcaacattggttaccctcacgtttgagaggttgggcaacccataataccttgacacaaatggatccatgtatagagattggttctgtggcctcggccctgaattctagggagattttcagtaatcacattttacagtgagtgctgtcatgcaacagagagcttacagaggtctgatgctatatttgcactttgaagaagaacccagtcgttactttagtcaccctcgaaatacctactgtagatgtgttttattgtcatgtctataagtgcttgggcagctcaacttgagtgttgatccctacaaaattgggaggctaaggtcacatttgatgtggctattgcttcaagaggaagcagtaaatctttgttggaatgccagggctcctttgtgcttccattgatatttctgtatggtagccatgacaacttttgtgtgctgggcccggtagtaatagatgaggcaaccacaagacagtttctgcacaatgaaattgcaccagtagtgccccagaaaaatgtctctcacctctgacctttatttaaaaaatacaacaaaagccttgatttcctttcctttactccttagggaagacattcttccaagtttcaagaaagggtgcccttgcttctctggaaggcctttcatccctgtatccctctccagttccttgtgaccattcctaactctgaggcagttttggaaaggaaggtaagtggttggattaggttacatgatgtgcaagtaaaggtagccgtgttctgactagagagaagaggatgacatttttagaatgttggtgtctcataccttgatacttatgtggccatggtaaataggtacaggatgacaacacaggactccagggccatttgggactcttcccttcccatgagaaaggagctcgaagggacatagccttttttagggatagagaagctctctatgatatccaaaagagctttcctccacatgatgtcatcctttgagtaaatatttcaaagatcataccccacagggaatttacccatgtggataggatgagattttcactgttgccttggttcccaccactttcctaatttccttcatggtatcatttagggctcttactgaacctctctgtagaatcaccaacgaaacaggggcttatacattaggttgatagagggaaggccaggtgtaaggaaccaaattgcactctgattcatgacaccaaggcaggagttggatccagtaacagttgttaccttcatgttttagaggttgggcaactaattacagcttaacaccaatggatccatggctagacatttgtcttgtgtcccaggaccatgattcttgggagattttaagcaatcacatttcacagtgagtgctgtcatgcaacatagagcttgcagaggtctgatgctaccttttcactttgaataagaacccattggttactttaatcacactcaaaatacctatctgtagttgtgaattattttcctgtccaaaatactgggggagctcaacttgaatgttgatcacttccaaattgtgaggctaaggtcacatgtgatgttgctattgcttctagaggaagcagtaaatctttgtttgaatgtcagtggtcctttttgctttcatcgatgtttctctgtggtagccatgaaaccctgtgggtgttgacccttctactaatagatgatgcagccacaagacatgttctgcacaatgaaatttttccataagagctccactaaaacttctcgcacctctgacatttatgtaaaaaggatacaacaggtctcttgacttctttccctttcctccttagggaagacatctttcaagtttcaagcaagggtgcttttgctccctggaagacgtttcttctctgcatccttcttaagttacatgtgaccattcctctctctgaggctgtttttgtaaggatggtatgcagttgggttaggttaggtgatatcaatgtacagtcagccattttctgtctaggcctttgtcaatgataacaacccaaaatcatgaacagaggtgatgatataaaaatcatgctcaataggattacgctgaggcacaaagaactgggttacaagcagtcacttgacacattggaaacctctttggtgacttcaatgaggtcctcagatgcctgtgccttctttttcaagagaggaaatgtggacatctatggtgtacattggttggcaaatgctgcatgacaacaagcacctagtcccacattctaaccttgggcatttctgaaaggcctgcccattgctcatgaccctgtcctttctggtgttttgcaatcatctgacatgccaccttgtaaggcagagaaacacagatatcaggtaagtgaaaaagatcatggctaaagcctccccttccatgtgaccagctccttcatgtctttgctctcaattctgagccagtctgcccttttggaataacaaaatggtatgcaatggtacctaacaaatctcgatttaggctctgttatcccttgtagacctgctgttttgcaaacctttaaggaatttgttcaactcccaataatttttttctcatagttttgacctacttcttatggatagaagtggaagacaattttggaatgttgggatctcaaacttgaattattacatgtccatggcaaataagtactggatatcaacacaagcttccagggctcattgagacttttcatatcccatgacataggaggcccaaggaacaaagcctttcttaaggagagcgaagtattctatgatatgcaacagggctggcttccacatgatgtattcacaaagggcaatcccttgagcaaatataccaaagatctcaccccacagagaatttacccatatggatagagtgagattttcattgctgccttgggtcacaccatcttccaaatttccttcatagtacaactaaggctattactgaacttccctgcagaatcaccaaagaaacaaaagcttatacattaggttgatacagggaaagacagatgtaaaggatcctaattccactatgattcatgacacttaggcccaaattggatttagcaacggtggttaccttcacattttagaggctgcacaacccattatagcttaaaacaaatggatccatggctagacatttgtactgtgccctgggctcaggattctcagggggttttaagtaatcacatttcacagtgagtgctgtcatgccacatagagcctgcagaggtttgataccacctttgaactatgaataagaacccattggttactttaatcatactcgaaatacttatctggagttgtgttttattatcctgtccatattactaggcgagctcaacttgattgttgacccctatctaattgtgatgctaaattcacatgtgatgtggttattgcttctagaagaagcagtaaatctttgctggaatgccaggggtcctttgtgcttccatctatgtttctctatggtagttgtaaaaacttgtgagagctgggacaggtactaatagaagaggcaacaaaaagataggttctgcacaatgaaattactcaagtaaacctccactaaaatgtctcccacgtctgacatttatttaaaaaacaaacaagtgccttgaccgatttccctttcctccttaggaaagatattcttcaaagtttcaaacaagggtgcccttgcttccctggaagaactttcttgcctgcatccctctccagttacatgtaaccattcctaactctgaggaagtttgggaaaggaaggtaagtggatggtttaggttaggtgatatcaaaatacagctagccattttctgtctatgccttttcaatattggccatcataggtcatgaagagtggtgatgacattaaaatcatgatcaataggattacactgaggcccatccagggcaacagggttacaagacgtccgttgactccttggggggctcttgggtgacttccctgaggtcctcagatgcccttgccctgtttcccataagaggaaatgtggacatctaggatgcacattggttggcaaacattccattccaacaagcacctagttctacattctactcttgggaatttctgcaaggcctgcccattgctcatgactgtcttttctggtcttttttgcagtcatatgacatgccaccttggaaagcagagaaccacagatatcaggtatgtggaaagatcatggctaaagcctccccttccatatgcccaggcccttcatgttttggtttcaattctgagccaatcggcccttttggaatttaggaataagaaaatagtatgcaatcaccaaacgaagctcgatttaggctatgttctcccatgtagatccctagtttgcaaagttttaaggaatttgttcaactcctgataatagatttctcataattttgacctacttctcatggagagaagatgacatttttagtatgttgggatctcatacttggattcttatgtggccatggtgaataggtacaggatgacaacacaagcctccagggccatttaggactcttcctttcccatgacacagaaggcccaagggacagagcctttcttagggagagagaaggattctatgatatccaacaaggctggcctccacatgaagtgttcacaaagagcaatccctttagcaaatattccaaagatttcaacccacagggaattcacccatgtggagagggtgagattttcatttttgccttggtttccaccaccttccaaattttcttcatggtatcatttggggctcttactgaacctcactgcagaatcactgaggaaacaatggcctatacattcggttgatacagggaaggccaggtgtaaaggaacttaattccactttgattcatgacaccaaggcccaaatttgatccagcagtagtggttaccttcatgtgttagaggctgggcaacccattacagcttaacacaaatggatccatggctagacatttgtcctgtgccctaggcccaggattctcgggagattttcagtaatcacatttcacagtgagtgctgtcatgcaatatagagcttacagagttctgatgccacctttgaactttgaataagaaaccattggttactttaatcacactcgaaatacctatctgtagttgtgttttattgtcctgtccatagttctttgggagctcaacttgagtgttgatccccacaaaattgtgaggctaaggtcacatgtgatgtgcctattgcttctagaggaagcagtaaagctttgttggaattccaggggtcctttgtgcttttaattaggtttctctatggtatgcatgaaaacttgtgtgtgctgggcctggttttagtagaagaggcagccacaagagagtttctgcacaatggcgttctgagtgtttaataaccatacttggaggctaatgttcagaggcagtgaatgggagaatattttttcttggccctccaaggtcattaagtcccaaaggactgtgtgttatctctagaaatgttcacacactgtataatgtcacccgtactcttgttctaggatgctatggtgaccccactaaatgaattctaaccctttgcatgatacagatgctttgcatcttttaattttgattgtggcctcttagagagattcttttctgggacgttttaagcaatactctttttacactatgcttcttcacaccttgaagcactttagaaagatttatacccaaaaacttttaaaagcagttcaggtgacccctaaagggaggactaaagggccatgagctattcatccctcttcttgacaccctagggtgcagaactaaagagctggactgaaggcttctttgtataatcagtaatcagaaaactttttttaaaaaaattaggtcagataacatcttttggggccaatttgattctttggctgttgtagtactccaaaactaaagatgactagatctgactactgctaaggataggatttgtgccctacttcagaaattatactggtgtgagatggagacaaaaatccaatggcatgcttcctcctatggatggccatttgattcctgcctactctggctcctctcctttgtcatttttatcttaattttcaaccatgccaatatttctaattacaacacaaaatatgaatcctaaaattttaaggatccaagtcattttaagcacaagtatctaaatatctatataacttataataagatactttaaatcacaaatgtatgacatcattttgttgttttcaaccacagtgaaatgtcacataatattgtgttaatattaacccacaataataataatttaacaccatgcaataataaattcatattaagaaattaatctggacagatttcatagcatgaatttggataaatttttaaggaaactgctctgacatattttcctaacttttaatatgtttaataggagtttctaaaaatgtttatttctaaatagtttgaatatataattggtgtatgagttttcttattaattaaatttgttctttgacaatttcatgcatgtataaaatacattttaataacacttatttacctcttccccctcctatcattgtcaacccaccctctttaccacaagcctctttcctgtgtttatatctttctgttttgtatgcaactttgctttgcaagggtcatttgtgtatccatagacttcagaattatccattgtagcctcataaactcatggatataaaaataatgactctccttccaccgtatacatcattaccaatagtttagcaaaaggtaggtcctcatgagtcctgcccccaaccatagatggttataatagttccagttttatacagaatgtagatagccactggtactatgagctaatagttgcagtagattcattacatctaggagaaagtagttcataggtcttatctcaatctcctggttcttacattctttttactcccctttatttatacaggatggtataattacccctttagaattgagtacttaactacctgttttgttttacctgttttgtttacttgttttcatgaccatgcatgcttggtaacaaacaaccaagaaagaaaaatatgattaaaggtcccaaattgagatgttatataacacaggacataaagcagtactcaaccttcctttctgatgctgtgaccttttaatacagttcttaatgttgtggtgacacccaaccataaaactatgtcactactacttcatacctgtaatttttctatcattatgaatcagcttgtaaatatctgatatgcagggtatctgatatgtgagctccaaagaggccatgacccacaggttaaggaccactgacataaacggttctaatacagaatgtgtgtgccaaaatatagaaatatgaatggtatacaacatatacttattattctcatgtaattgaaattttctttgtttagtattaataattacatctttatggaattttcttatgagtgactgtgtgtgtgtgcacgtatgcatgcaggggcggggcatatgtacatgacagtgacgaagaatatcaggctctcagtgtttcttaggtgctgctgaaactgttattttcttaaatctgtagtaaacacataacttaagaacataatattataatatttcacttatatttcataattactctctaagtatatattacatatgctataaatctaaggtaatttgtaggcctagtgaaacagacatcaataagcctaatgcccttggttaggatcaggaatagggaaaacatacatggcaagaaatccttcaacctttattgaaagaacttacctattttttttttataaaatagaaatactggatattgtcctgagttgcctcttgtaacacagtctattgatgtgaacatggcaataatattgtattccaatgtgaaaataattccttagtttactgagaatatatagagatgtttaccattagaaggtttgcattaggttattttggtgttcatgtctttttgttccagtcatttaagtgataaatgcagaaagtttaatcttgtagcaatatttattcctcttactttttataaatgtcaaattgtcccctccaaaactttctttcccctattatcatcctactacaatggctcagctaaaggtcattaaattgacctattcctagctttgataaactaaaaactattttgcatttttaaatatgattttgaggctgagtgtctatttcagagtctgaaagcacacctaatcttgcgcgcgcccaactggccagaaagaacgacgctgcaacaggatccttctgcacacgtttattcagtcctgtttcttcattctctatatctcccttgtttatatctcccttgtttatatcttccccttgtttatatctcccctctcgaataataattcttcctctaacccgggcctctcactcttatatactctcagccctcatccatgcacagcaggccacgccacctcaccaggcacgcagcttcagctaatcagggcagcaggggcatatctccatcaaaatggattcaccagtatcctggtacacctgtgcagctctcaagatgtttgtggcttatatgaggaagtcaggtgcaagccatatgacttagctgcagtccctggagccttcttgggattgcccccacacccgctcctcacaacctaatatgttccaagccatatacatatacatgtacatgtacatgtacatgtacatatacatatataataataactgtcttttctttactgtcacaatgaataatggcacatgaaaactatgaaacatttgttgaatcaggtaaataaataaaagctactaatgttctctttctaattatactttcacaccttttgactcaaaaaaaaaaaaaacccaaaacctattttgcaaatcctggcaatggaactgtagtaaattaacccagttatagaagagctaacttgtcaggaacaggattaccaagatcagtgataaacaaaatctcctaaagattgagaattatttcatgatactaatctacatgccctttgatagcaaaataggatttccagaattatttaaatgtgatatcctctttactaaaaatgttcctacataataatttcctacacaatagtttccttactaaatttcattatcaaaatggctccaatgggcagacattagccttaaggtttcacattaaggagaagtttgatattttaattactgtgaacagtttgatattggttacatccaagtattgcgtgaatacttggttacagaaatatatagaaataaaacatgatcaactggtaataaagatgaacgtaactatcagtaaaattgagaaagttccatgggaaaacagatacaaattatacctaaatacaactgtattagtttattataatagctatttattcttttgcaaattgatttctttaatttttgcttttgttatttctgatgaataaaatatcagcattagcatcatgtttagagagagaaatcagcatattcctttgtcattacaagttgttataggctaagatgatcataaaattagttgacacatttaaaatgagtaaaatgtgtatttatatatgatgcatatatattaaatatatgtatatattttatacatttaaaatgagtaaaatatatgtgtgtataacacatatatagtaatatattaccatatataaaataagtaaaatgtgtgtgtatatatatatatacatgtatatgtatatatatatataaaatatcacataggtagatgatagatggatagatagatagatagatagatagatagatagatagatagagaaaaagtgtgtttaagctaacacactcagaaatagatgaaaacctagaaactagggtaaagattaacggctgaactgccatttatacttgctcaaggagataaaaatcagctttctccagtgaagggacactggatatatcaacctctcaagggtaggcctcatgttcagtagtagctgaccaacatataagagactccacagtttttttgtgtacttgcatttggttacagattttatttttctttttgaggtattgtttcattttgttttctcagtttacaatggttgttgtattaattttttttgttggtttgtttggtctttttttgaaggaacttaaatttgagtgggtgggtaggaaaggggaaaggatctggaaggatatacacaaaattaaaaagaactaatcctttaagaagataaataacgctaacaaaatgaatcaatgattttaaaagatacaaatacatatatgaagaaatatgagaaaggatactatagattatatgtatattaaataatagtaagagaaatttatgaatgtgccaatgaactcagcaatttaatgaagtaaatgaatgagttgaaagattcaaatataaaaatttatttagtacatagataacagaatactgttttatcaacaaattaaatccttattgaaaacattcctacaaagaaatatagattacacagaattttaagattttatcctcatatcaccttctagaagatataaaaaaggaatagtgccaagctcaatatatataaaaaagtaacaccttcatcaaaaaatgctacatttaaaatgaagaatatacagcaatatttttaatgagtatagatatatatctttggtcaattttttataaaatagcatctaacaatatgcagaaatatttatgattaaatcaaattaaccattgaatgaaatttgttttacaatttcaaaacaaatctatatttaaaaaatcactagacagtcaaggtaataaaaacattaggaatgtatccttccataaaattactatttacatgaatattcaaaataagccaggtatagggatgtacatgcaatctcagcactgagaaagccataaagcagataaatgtttatttcaagaccagcttgtacaacaagtaagaccttatctcaggcagaagtcaaaattaatatttggaattttgtaaattaaccaaagacttaacaaaattacaaagaacatttatgcaagaaaagtgtctggctctcagtttacaaaaagcagaatttgtgttacttttaacatgtctttatttcatactcctccctgagacactgtggtagcattgtaaatcagcaaaatagaagccatgagagaagaagcaaagatttgtacccccttcccatcctaatccccccaaaataactattttgacctgctaagcagttctgtagaaaaatatatcccatgatatttttagtaatttgggctgatgcagaggcttatgtgtgagtaaacccccataccagcattaagcataactaattaatataagttattgaataccatagaagataaactagttaacagtagctgagataaaaatttttaaaattatgaaactgtaaaaacaatctgtctggtaaagagaaattttgtggtataatcaggagttctgtggaaaatgttaccacactgcttttggtattgagtccacatcaatattcagagtgcatggtagcatatgaaacatatgaagtccctagttgcttacttcttaattatcactaggccctgtgtaagtagtaagttatggctaagaaacagttgtgaactacctgaataccacatgtgaaccaaaatacacatacagaacatcccttaaaaataatgagtgacatattgtttaaagttatttaaagaaatctctatctaatcattgcatgtgcttaaaatggaaaatacaattcagtatccacatacaacaacacacattctttatgaacaaaaataatgaaaaagaacagatcaaccgttaaaacaaactctaggaatgataaaacatattttcatgcatatacattatatgtaaaaatgtccagtttcaaaatatatattgtcttagttttggctttattcccatgtaaagataccatgactaagacaactcttataagggatatttaattggggttggcttacaattctagaggctcagtccattatcatcatgccaagaagcatggcagtgtcctggtgcagaagaaagagccaagaattctccatcttgaactgaaggcacagacaggaagaatgtctcttccacactgggaggagcttgagcaccagcagccctcaaagcctgcctacacaatgatatacttcttccaacaaggtaacacctattccaccaatgctgcatcccctaattttgccacttctatgggtcaagcatattcaaaccactatatgtgtgtatgtgtatgtgtgtgcatgtgtgtgtgtgtaagtataaaaataagagattaaaacacatgtacagaaaaagatatcaatagaaactggaaacaattcagatgccctcaaccaaagaatagatacagaaaatgtggtacatttacacaaaggaataccattcggctattaaaaactaggacattatgaatttcacaggcaaattgatggaaatagaaaatatcatcctgagtgaggtaacccagacccaaaaggacatccatggtatgtactcactgataggttaatattagccaattcgttcagaatatccacgatacaactcacagatccaaagaagttaaacaagaaagaaggcccaagtatgcttgaatcccctaaaaaggtgaaacaatgcagtaagagaggttagagggaaggagaaacctggctcagagaggggagtgtgaggggagtgaaggggggggcaggatcaggcaggaggacagacaggaaagaagcccagagggccaggagagtcagtgaaagtatgcagctgccaggtgttgaggttggaggattgtctaggaagtcccagagacctgggatgagggaacttcctgggaatcaatgcagacaaccttagctgaaatgccaaaaaaaggggaataggaaagctgatgagacaacatccagtagccaaacaggactcccagtggacggatagggacactaacacacccacaaaactttagatccaaaattggtcctatctaaaagaaacgcagggaaaaagatggaacagagactgaagtaatggccaactagtgactgacccattttgagatgcatcccatgagcaggcaccaatccctcatgctattaatgatgctatgctgttcttgcagacagatctgagaggctttacccatcagctgactgagacagatgcagatacccacaaaaacggaacagaggttggagaaccctatggatgatttaggggaagaattgaaggccctcagtgaggtggtagtcccatgggaagatcaacagtgtcaactaacctggacctttgggatctcccaaagacagcacaaagctcccaaaggcagctccaatcaaaaaagcacatacaggctgatctgaggcccttggcacatatgcagcaaagggctactatgtctggcctcagtgggagagaaaatgtctaatcttgtagagacttgatgcccgagggtggggcctgaaaagggagggctgctctctcagagatgtgggggaggggaaatggaggggaaactctacaagggggggggggagtccaggagagagagcagcatttgacatataaataaataaataaataaataaataaataaataaataaaagtattcttaaggaaagaaagatgttggacctactagacaaaggcagtaagtcaacttttaaaaatatattcaaagaactaaagaaaatgaggaaatatttacataatatatgaaaatgatgcttcaagaaatatagactaaaaaacagtaagaaatgaccacatgaaaattacttatgttaaaaaagtaagtgtgtaatgtgtatgtagtttaatgggagaaggcttgaccagcatattcaaagccctggcttccatctaacactgggaaaaaaccaacagaaatatacatgatataaagaactctcaataatgaatgtcagcagaccagatattggctaacatgaatatgctctaagtaagattatctagtcaaagtacgaaacagaaaggaaaaaaaatagctaaaatatagaaaaataaactaaacaaaatagagccatagcaaactgcatttatatcaacttatacattaatgtgagtccaagaaggaaaaagagaaaggggaaatttttaagaatgatggctcaaggggctggagagatggctcagagattaggagcactgactgctctggaaagaagtcctgagttcaattcccaccaaccacatggttgctcacaaccatctgtaacgggatctgatcccctcttatcaaagataacgacagtatactcatatagattaaataaatctaaaaaaaaaaggatggctcaaaactttccatatatatataaaaccaatgtaccaaacaagaatataaataagcttcaaataagataaattcaaatgcaatcatataattctaaagaacaaagcatagtagtgaaactattgaataattaataaaaagagaatgtgaagaatgtgtaaatatcaacaacacgctcttcatcataaactatgcagacgagcaggcaatataacatatattataatattacaatataccataatgaaacaatatttaacaatttaacatctatgaaaatacactcatattctcatcaataggtataatgtccagacaaaaataacagaaaaaattcaggtttgaactgcatcatcagcccaggatgaaatgaatggataagctgctgaggtctatcagataattaaagagtcattatcgccaatatctccaaaattattctctaaaatataaagttcatcaacagtaacataagttatgagtacagtattacattgatacaaaacttaaataaaaatacagtgaagaaaaaaatctataatgcaattgttctgaggagtatggatgtaaaaattcttaataaaaatgcttaaccaaatccaaatatacatcttaaaagatcacatactaatacaaaagttgcttcattccagagataaaaggataattcaacatatataaggcagtaaatgtaacaaacatgcacacatatgaaacatagatcaaaggacagaaattgcatgatcattgtaataaatacagaaaacagccttagaataatgaataactgttcatgagaaaatactccaagtaaactatttatggataaaaagacaataccttgatataataaaggccataaacataaaattatagcaaacgtcattctcaatgggaaaagaactgacagcatcacttacaaagttgggaaataagtatatctcgtctctccacttgtcaatataatgcttaaattattcacctaggtaataaagcaatggaaatacagggtacattaagtgaaataattcaatccattcctattacagacaatatggacctacactcactgggcactaaaattctcctcagacaggaaaaccaactgatctgataaatgctcctaggaaaatagcaagatataaagtcaacacaaaaaggtatgacaacaacttttctatatttgcataatgaacattctgagcataaaactggtcacatttacaggaatgtcaaaacataaccactagaaataaatctcaccaagaaggtaaatgatctcaacaatgaaaaccttaaaacacttccaaaagaattcaaagacacgtggtttgtaaattgttattttgggtattctgagtttctgggctaatattcacttatcagtgagtgcatatcatggatgttcttttatgattgggctatctcactcagaatgatatcctccagatccatccatttgcctaagaatttcataaatgtatcgtttttaatagctgagtagtacattttctgtatccattcctctgttgagggacatttaggttctttccagcttctggctattataaataaggctatgaatatagtggagcatgtgtccttatgacacgttggagcatcttctgggcgctcagtattactgggttctcaggtcctatgtccaattttctgagaaaccaccaaactaatgaaactcaagaacaaagaacaaagtgtggatactttaatccttcttagaagggggaacaaaacacccatgaagggacttacagagacaacatgtggagcagagactgagggaatgaccatacagagtcgcacctgaggatccatcccatatacagccaccaaactcagacactattgtggatgccaacaactgcttgctgacaggagcctgatatagctgtctcctgagaggctctgccagtacctgacaaatacaaaagtggatgctcacagccatccatgggaccgagcacagggtacccaatgaaggagctagagaaaggacccaaagagttgagggggtttgcagccccataggataaacaacaatattaattaaccagtactcccagagctcccagaaactaaaccaccaaccaaagagtacacatggtgggactcatggctccagctgcatatatagcagaggatgtcctagttggacatcaatgggagaagaggcccttggtcctgtgaaggctctatgccccagtgtaggggaatgtcagggccaggaagcaagagtgggtgggttggtgtaaagggggagcaggaaggtgagggggagggtgttttggaggggaaaacaggaaaggggataacacttgaaatgtaaataaagaaaatatccaataaagtcaaagtcaaaaaaaaaaaaaagaaagaaagaaagaaaagaaaagaaacgattaaaaaaaaaaaaaaagacaccggaagacagattggtagagttaataatgtaaacatagctctgcaaattaaagtgattcacattttcaatataatccctattacaattctggaaattgttggaagaattattttaaagtttaaaaacaacactgagtacaaaaacctatgaataaccaaagcaatcctaagcacaaacagcaaagttggtattgtcacagtatgtaacttcaaacatagtatagagccattctgataaaacaacatgatacttaacacaaaacagacacatgaacaaatatactaaattatactaaataaaacaaaacatataatcccatgctgttgtgcccaactatttttttgttttttttttttttacatgagtctcaaaattatacattcaggggaaaacatctttaataaatggtgctaagacaacttaacatatatgtacaagaattaaactagggctgaagagggcttagcagttaagaacattgagggctcttccagaagtaatcggttcaattcccagaacccatgtaacaactcacaaccatctgtaactccatttcccagggttcagatacctctgcaggcttccttgggaagccaggtagccaagtgatacacagatatacatggtcacaaaacactcatacatacaataataaaaaaattaaaaaaggataaactaaattcttctctcttaccctgcataaaaatccactgaaaacagattaaaggctttatttaataaaggctttatttaatgtatgacccaaagaattgaagtggactacatagaagcacttcaagatatagaaaggcaaggactttctgaaagtaggtcagaaaatgttaggaggaatttacaaaataggattagattacattaaaagtttctgcacagcaaaagagacaaagctgtagagattgctcagctgtttcagttacttactcacataagaactaagtttggctccacatggtagcacagttacctctaactccacttccaggcaatctgttgcccccagttctctgcgcacacatggtacacatagcctcataaaggctccagacataaaaaaaaaaacaaaaacaaaaacaaaaataaataaataaacttttaagagtaaagattcagactacacatggaagaaaatctatgctgttttatttttttatatctgagaggggactaataccaagaatatgcaaaatgctataattagattatgctacctgaacacattaagcagttaggaacattgagggctcttccaaagttaatcggttcgattcccagaacaattgtggttaaacattgaaaccacaagtaatatgaattttccataaagaaaaagagatctttactgataaagctcaagtgaccaataaatacatgaataatgatcagtatttttaaccattaaggaaatgcaaatgaaaagactggaaatttatcttatgcccatcagaaaggctacctctaaggaaataaactagactccttgtggagatggctcaggtagtatagtgtttttctttcaagcatgagaacctgagtttgaccaactaaactcaagtacaaagaagccaggcaaggtggcacaagcttgtaatgccactgtggtagaggctgagacaggtaggatctctgggactcactgttcagatagcataatctactattccaggtcagtgagaaactctatcacacaataaacaaaacaaaacaaaacaaaaacaaataagcaaacaggaacaaccatcacaaaacaaaaaacaagtgaatagaaacttaggaaagacttctagcctccatttgcacacacatggaaagcaacaacagaaaacactgaagaggatgggaggaaagaaggaccactatacatagctagtgacaatatgaattagttcagccatactaatcagtctgtatacaggtttctcaaaaaaaaaaaacaaaaacaaaaaacaaaaaaaacaaaaacaaaaaccgaaaattacaactaccatatgatggagtgatgccactcttgggaatgtaattcagtatagagatatgtgaacatccttgtccagtaaggaacaaattaaaatgtagatggtatgaattagttttgatgttcatgaacagattaatagacagctgggattttcttcatccataaagagtaaaatgatcacatttatgaaaaaaattcacaaacacaaagacacacacagactacacatacacacacacacatgaatggcatggaagtagggaaaagtattcaggaaaggcaaagagggtgagttgtaagaaagaagatcaataaaagatcataatgagtgggtgatgaatgtgattaaagtagaacatatactatcatgaaaatgcaatcgagcaactggagagatggctcagtggtttaaagcactcactactcttccagaggtccttagttcaattcgcaactaccacatgatggctcacaaccatctgtaataagattccatgccttcttctgatttgtctgaagacaactacagcatatatatatatgtatatacatatatatatatacatatatatatacgtgtgtgtgtgtgtgtatatatatatatgtatatatatatatatatatatatatatatatatatacatacagagagagagagagagagagagagagagagagagaataaaataaaaggaccaggagtcagaacagatttggggatgtaaacaaacaaatgaataaattaaaggataaataaaatgacataaagcccatcactttgtactagaaatatatgctattaaaacaaaaagaaatgatagcatctagctgcatattacatttctgtagtgaataactatagatggtgtgatttcttaaagtcagccacacattacacattagttgcatccaagatgctaaacatattagaattcgtgtaatttcaacttactgagtttaaactggttagtataaaagtcaaccatttcaatgaaagttactatattttatgtaaataccttttcataattaaaatctattgacacaattatggaaataaaattaaagcacttagcacaagctagcatatacacacactttccacttacatgtgtgataaggttaaacagtgagaacatcttgtctttgatttctgtttggaatgctactggttcttactctaatttattcaacaaatgtacatttatttaaatttccatttcttgtgtgacttttatcagagcaattgatcaaggaatgggtaggttattaagttggacacagaaatgatcattattattttaataaaaaccattgaatacatttaaagttataactacatccttacaaaatttatggatcttttctaagacccaggttttattttacatatttggtttcattgattactgttaataatagtttctttttttgttttttattagataatttctttatctacatttcaaatgttattccctttcctagtttcctctccggaaatccctaacccacccctcctgctccccaacccacccactcccattcccagtcctggcattcccctatagtgggcatagaaccttcacaggacctattgcctctccttccattgatggccaacaacccttgatactttcctactgttgccttctactaaggttgtgattttggtttttcattgtaatgtatggtgttgaaaagaagaaaaaaaatgagtcttgctcatttttatttacatttggtgtgactggatgttcaaaccagtggcactgaggtgtttctggttaaacaatgttggctaggatcatctaatactaattcttattgcttttgtgttgggataagttgtggggggtctcaatgttccctgtcacctccattgatataactatgataggaaatgaaaaaatcagttctcttcttggtaccacttgcaggtgatggaagttcatctggcacaagcctggcaaggaaagtgatatactatttttaccaatacatgtattttcctattccatgctgtcctttcttataaatcataaacatggaggggaaagtgttaccgttgctttgcagacactataaatatatttaatgtcacctaaaatagaaaataacttaggacacaagtagatattattagcagaatatgacatattgtacaagtactagtcagtatagtaagtaatgaaaaaaataacagacttgcaaatttgaaaaggaggaaagacatttattcatagatgacatgtttatctataaaaaactgaaaaccaaaacaagaaccctgagattcaactagaaattggatatctaacctataatcagagcactgaataggcttgtctcttgctaattatctttgagatacatcattctaagaagctacttgtttaactaggttacctgctaaagttttatttaaacaccatcaatgaacaaagactctttattctttttatcagtgacatcacttaagtacagacaatataatacttaataaagtaccaaatgcagagctcaattttggcctgttaggttaagtttatagataaacatataatactagtagaatgattatatatgtcttctaggaaatccttacctactgtttcccaaaattaagaaaatcataccatatcacaagattagacagttgacaagaaaaacatattcttatcaagaatattgtttatgagtgcttatttacttggacaaaaggtatagtaaatggcttctcatatgaaaattgaattggctatacaatacaaacataaaaatggtacttttctttttgaataagttagactgattttcactcaacctgtctaacttgagaacatttgacttactggcaaggggttccaaacgttagacaagatggcacaactttgttatctacaacattctcagttaagaactgtaacagagagagagaggagagagagagagagagagagagagagagagagagagagagagagagagagagagagagagagagagggagagagagggagggagggagggagggagggagagagagagagggagagagagagggagggagggagggagggagggagggagggagggagggagggagggagggagggagggagggagggagaaacacatcctaaaatctcatcatttaagtaaatttacaattttgtgttatgttgtatttatagcttttcttgcttcatgaagtcttcttaagcctacaagccacagtttgactatacctgaatagtttaaacctagtgttgccttgatggctttctatcctgataacctgtgcactctaaagtagtgtataaagatctaaggctttactgaaccttagatatctcacttctcatcgtttaataattgctttctacatttacacacaccaatattgggtggatatatttataattgttataaggtaacttctgtaatccattttaaacttccactattgtctccttgcctcccctttgaatttacagttcacattttaaagaatttcaaaacaccccttatttttcattgtatttattaggatagctttggccaggtcagggacatacatctttatttatagcacttgggatttaaaagaagaagttcagataaaccatgaatacataatgaaaccatgtcacaaaaaaaggaaaacattttccttgatgatattcacactaaagattgtcactaagcctcttactttattatttaaatttgggggtgttgagaatgaaatacaaagccttacatattctacacaagcagcctacctctgaactttgcatttggttctgtttccactgtaattaacaattttttgtaggactggagagcaaacctaggatttaatgcatccaaggtaagcactctactgctgtgccaaagaccctaccaatttaacattttacataaggcaggccacttttatcacattaacttttaggggaagagggagtggtctgttaagtctcatgtttctgaaggatagctctgttaagcatagtaattcttggttggcagcactacaaccatgtaataacataaatattaattcatttatggatgactgggacatagaagctctgacatattagtcaattaagcctaattgttggattaatctgaaggcattattgaaaaatggtagacagaacaataggtcaccaggttgttgtctgtagccatgtcttagacttttcatgtctcttcctggttcttgaccactatgaggtgaacagtcttgcttcatttatcatatcttctgccatgatgtcctgcacttgtaatcaacaaaagcaatggaagcagtagatcatggactaaaaccaccaataccatgagtcataacaactgtttcctctttttaaattgttcaagtattcatcaaagtagacagcagatgcaatttttttctttcatttctaaagttttctttttttttattagatattttacatttcaaatgctatcccgaaagttccctataccctcctcccaacctgctccccgatccacccactcccacttcttggccctggcattcccctgtactggggcatataaagtttgcaataccaaggggcctctcttcccagtgatggtcaactaggccatcttctgatacatatgcagctagagacacgagctctggttagttcatattgttgttccacctatagggttgcagagcccttcagctccttgggtgctgtctctaaaaattcaggtgacaacagatgctggtgaagatgtggagaaagaagaacactcctccattactggggggattgcaagcttgtacaaccactctggaagtaagtctggcgattcctcagaaaattggacatagtactaccagaagatccagcaatacctctcctgggcatacatatatccagatgcaattctttagccctttaaaaacttctctacttcaaagcatgatgtttctattgaggtgtatgctacatatacgagagggctcttatatatggtttcttttgttttcaacatttttctggtgtgtgtgtgtgtgtgtgtgtgtgtgtgtgtgtgtgtatgtgtgtgcgcgtgcatgcgcagaggcgcacatgtatacctatgtgtgtggcacaaggcaatgactatgttctggggcaaatacatagaccaaacctggaatcccgtgaactacctgtacctgggtaactttcacctagtataggatgtttaatgccattaattcttcagcctcttaaacctttctctttgttttatcttgaacacaaactatttgaacctttgtcctattgtaacattttgtgctattgattcaagccagggaattgggtaagcaaagcaaatgagccaacaccaagttaaaaaaaaaattcctttttaatcgtgctccaccaatgccacaaacttccttcattcattctttatttttctcttctttctatatattttcagataactaataatctaggtaagagtttttatttttgaccaatgtgttatttaattgatgttttcaggtctaatatttgttgctattgttccaatcttttaaccttccagtcatgtgttatttgttttgaatcctcaatcattatgtttgaatatcagttaaatttgcagtttggtaatctgatacatatttttattacattcgcctaattgctcagatacttcacacatttccagtttttccttattaactatttgttctttccccctatattataatgattttgagcactcttttgacccttgtaataatgacttagtgtgtactaaagtagatactcattccaagttttttcagtcttcctttggaaaatgcctgttcaaagaccctggacagagtgccacaacctttgagcccatgaccaacacagcctttgaaacactagggaattctctcactccaactctacactggctagcacaatgctggactagaatcctgtggctattgatacaggcagagatttgagaagcactcaaaacctagaggtactgatgctaaaacagcactaaaatatgcccaagttccattgccaccaagccccttgtagtcatccagtagtgtgtaagagaacacagaccaattccatctggcagttgctacatattcttatgtgatatgagtaaactgttgcagctcaaatcacaggagggtcttgcttcagaggtcatactattctgatcaataaaggtttttatgtcatgcctagttggtattggggtccatagtaaaacttacatgcttatttatccaattcattcactagctatcaaactgcatacatatacagttttgcttataaattagttggtggatattttgtatgtctttacatggtgactattttcaagagtgtggcttttaaaagttggtagaaagactgctggagaaatggctcagtggttaagagtgccaaccgttctgcgctggagagatggatcagtggttaagagcactgactgcccttccagaggttctgagttcaattctcagcaaccacatggtggctcataaccatctgtaataggatccagtgccctcttctggtatgtctggagacaactacaataaatacaccttttttaaaaagcacaaaaagaatttttaaaaaaatgtggaaagcttttgtttgaatacttcagttcatttggtgatatacttgctaggcaaataatcaagtcataccgattctctttagtttactgaggaaccaccaacttcttctttccatatcagcatgattttacactcatattagtcataaacattctatatttttccatacttaccaatatatttcatctttgaagagaaaggccatttagtgggcataataaagcatctgattttggatgtaatttgcactcaactaaggaatagtaaaggagagcatcctttcaagttcatgccactaagtatatgtatgctttagcatctaaccgtttagaagtttttgcttggttcattgttggactcgactgtttttgctgcagaattaccatgtgacacagctattccatacactggatctttatcagatgcctatgatttggttgaaccaaaaacctacttgctcttttagtctttatcttatacctgaaagttaattttaaaattgaagattacaaacattttgtgaagattgaggatattcataatacttaaaccttttgttcatttttagaaaaaatggtgatctatacttactcttttttaagtgaaaatacaattttatataaatacttttgtttatttactgtttggcatacaataaaaacattaaaatcatcgagcctggagatcagtttaattttaatattatatacaacaattctagctctgatcccacataccaatacataattatactcatatattatgcacacaacttatctataattgctacaagttttcttgaatcaatgaaaaacggtgaaaccccacgtacaggcagattattacctaatgacctttcctgttatttctatttattcgaactattgtctactgacttttgtttcagcttgacatactctacctgttataattacagaaaacgttttaagtggaaacagtagattctcaaactcatatcaaaatagtgggcttggttatcagtaatttgacacaaagtgaatgtttccttcttggagttatttaagctctttgttgaggtagggttttcatgtagccttggctggccataaacatatgtattcaaaaaagtccttgaacttcaatttttttctttcagttttgttaatggttacattatattcttttggagctttgatatttacagctttgtaaatactgttatgttgccttagtcagttgactaatccccacataatattccttgtttcctctaagtactaatttttaaagtctctacccctttcccaaacctgatatatatcttgctctctgccctaattcactttgtgttacatttgcatggaagggccctttttctcaatcttttactgccaacctgtttttttgtttttgttttcctggttacttctgctcttttaatttattgctcgtatatgtaaatgatcactgacaaatgtttgctttatatagtttggtccttgtgtgtctcttttttttcttttttttctttttttaatcttttactgtttggcttgcgatttcctccaatacagccattaatactcatctcttttttgggggacggagggtaatgtcacattttggctcgttgtttgcttttgtgtgtgttcttcagtattctttgtagaaaccatagggcattatatacattcttcctaatataaaaacaattttcattgaagtactgcataagggacaaatctaaacattgtataatttaaatttaagcatttaggaaatagtaattcaagttccaacacttgttttctaataccttttctttgctttgacattctaagagtgacaaaaaaagtataccttgtaactattcaaaatgatcaatgaaaggaagaaaacagttaagttgtaggcctaggaacatacagtaattaaccataatgaacaaagtacagatgaaatagatgaataagctaagtacagtagattcagtacttaggatcactgatgttttatatccagagaaccctacagtaatcatatccttctaaataatttttcacatggcttctatatgatacgatgatgcaaaaacatttgagctataaaggacttggaatcctttcagttttaattattgattctcacatctaaacttaaatttgaactgacagattaattgcaagaggcttcatagtggactactttatttcaaagtaccacaaattacacctttataaaatgtacatataacatgacttttgttaatttctaaaattcttcagaaatactgggtttaccaaccaaactgaatactgaggttgtttaatcttaaaccataacctgagtcgaaattgttccttccacattaatcttattctaattatttatttaaagcaggatcttactaagtagccctggccggccttaaacacaagagatcctcctgtttctgcttcccagtgctgagactaaagtcatgaactaacgctatctgtattctcttaaaaaaaaaaaaaaaagacctagtagtagtgatttctcaaaacttttacttaagaattcctcttaatattgctctcattctttttagaaacttccctggatataaaacctcagtgttagtgttctcatcctatacctccacccttcactctttctgcttctgtaccctcctttcagttcctcctcttaactttggacatcgaaaaaacaagctatccaatcatttaattggagacacatggatattagttgcttctttttgttgctttcaagattctgtctctggattttggtaagtctgattagaatggatcatgataattaccttttatggtttactctagactatactggatatcatatgcatgtacatttgtgcctcaaaaaaaaattgcactttttccagctattactccttgaacgttcactcttagggaaaatttggtgcaaatacaattagaataataaaatcatttaaaatgggaattttgctttctacagctctgtaaaggttatttttctgatagctccatagcatacaattgtctcaaaactattgttctaagggtcttgtacatcctaacgaagtgctttatcaatgaactataccaatgaattaaatcaattataccaatgaattaaatcaacaacccggataaccctacaatgacttgttttagggttcagattgtggtatgttatgacaaatgcttaaaacacatttttttttttaaattgtcatttcactgttgtgtgagatgctccatgtcacttacagtagttatccatggtgtccaagtaattatgggtttattgttgtcctactaatgactcaaagaggttattttaagatttgcaacttatgcaatgtagatatgtcgtttttcttgtagtcctgttatgaaaggttctagattcttccagtaatctaggactgctcttaagtatatagagaggtctgtcacctgttttcctaattttttagttagctgcatgtttgtctcaaagcgtatttgctattaacatgctcaacttttttgagaaaacactaagatttgtttccatcctttaaaaaatcatttttgatatgcatttaatatgtatttaatatgtcttatacattgaatagttaggcctttatacaaatccaactaaaattttctttgcaatgtagagtttatattataaagttttatcactttgttattctgttcattagcaccactatatattttcccgttgtttctgcttttatttaaattgagcattgtattagttccctaaggttgctgtattactgcaaactaagtgactaaatgacatagtgcaaaacaattcattgtgttaattctggagattaggcatggtaacattcaaacaaacaaacaaaagtattatcagggctttacctaaaacctgtatgagaatcactgtctcttccaggttctgatttttttcactttttaaaagtaatctttggtattcttcatcttgtagaaacaatgcccaatctcttgctccatattactcattttcttcctatttgtgtttgctctccttatatagtaaggacatcaggcaatactaaattacagcttattctaaagccacaagtctcaattaaatacaactggatagatacttccaattaagtacctcttcacaactgtcagatatggcaatctaaaatctatatgtatagtttaccaaacttaaaacttctggtaatcttcaaaattatttgtctctgactttcttcctgttaaggagctttgatttacacatgctacagaagaaagggccaagttgttgcttcgcttgttaccattatggtagctagaagttagcctttgccaacattccctgtaaaataggaacctgaggttaattgtcataagtacctaagagaaatacctgatcaacgtccaaattatatcttcatactctgacagctgagctgagtttaaaaaattatagtaccagtgtcttaccgggttgacaaaatgtttttaggcatttgttgagttttagatatgagactctcaaatttgagtggttatatattttcataagttctatcaaagctaattataacacaatttcaaagagttacaagaagctattgactcactagaaatcctgccagcattctgctcaccttcgttaggtatccctttccaggctcacctccattcctctctataccataaaacacagaaaggacaaagctcagattgcaataagacaaatgaattgccttctccattggctttttcatttccccttctgattttctaggacaatacatttattaatagttaaaagacaaggccagtgacatggtttagcatggaagtggacttgctgctatacctcacaatgtgtatttaaccccattagtcacacaatagagaaccaactcttgcaaaatagtctacatatgaaattccattaagaatgatatttgatatactacaagtggcagaaattttcggggatacactaataaaaagtgacaggagcacactgctagttttgtagagagcttgggacagtctgagatacagaagaggaatgggggaaagagtagggttctgggtaaattacacatggcgactatcagtggatcccacaaatgcgcactcgcacgtgcgtgcacacacatagtaacaattttaatgaacaaagtataaaatgctagtcctccactagaaatgactagtattgtatacaaggatatcttcccaattttttttttttttttgccataacagacatgtaactgaaatattaccttttatgacagaaagaaaaaaaaagagggaaaggaaaggggaaaggaaaggggaaaggggaaagaggaaaggggaaagaggaaaagggaaaggggaaaggggaaagagggaaggggaaagaggaaaggaaaaagcaaaggaaaagcaaaggaaaagcaaaggaaaagcaaaggaaaaaggaaaggaaaggaaaggaaaggaaaggaaaggaaaggaaaggaaaggaaaggaaaggaaaaaggaaaggaaaggaaaaaggaaaaaggaaaaaggaaaggaaaggaaaaagaaaaggagaggaaaggagaggaaaaaggaaaggaaaggaaaaaggaaaggagaggaaaagagaggaaaggagaggaaaggaaaaaggaaaggagaggaaaggagaggaaagtaaaaaggaaaggagaggaaaggaaaaaggaaaggagaggaaaggaaaaaggaaaggagaggaaaggaaaaaggaaagtaaaaaggaaaggagaggaaaggagaggaaaggagaggaaaggagaggaaagagggaagagggaagagggaagaggaaagaggaaagaggaaagaggaaagaggaaagaaagaggaaaggaaaggaaaggaaaggaaaggaaaggaaaggaaaggaaaggaaaggaaaggaaaagaaaactgagttcataccactaagctcatcactaaagaactggaagtttaaagtgttactagataactaaagagtcagcaaactacaggtttatgtcccctacaagtgctgttatatgtgacatacatgacaatttcagattgttcccattttattatttcctcttatgagttggttatgtagaaacagaaaaagcaaaaatggtagagatgaaaagcaaaaaacaaacaaacaaacaaacaaaaaccctaaaaccttacataaataatggtttacacatgcaaactaaagaacttggaagaataagttaaaagttgcatagtactgaacagatggtttaaagttacatataaaaacatgatggatttacccactatcatctaaggaatgagaaacaagctggttttccttctgttgctttcccatacaggtgtgcccctaaaaccagtagaggatttcgttttccctccacagtaggaaagtgtaaggagtatctgaatcggtagtaaagctgcatccaggatgagtcttcatacacacgaacaatctttgtaatgattttttttcttagctttttattgggtacttttgtagaaatttgcatgtatggtctggttggctacccaggatctttatctttgcaatcatttcatctatacattctttcgacagatgtattacagcctgggaattgaggattaaaaagaaaaaagtgaaagaaaagttgaaaccactcctactctaggacattatcaatgagaaattgaggcaataactaaagcacatacacaaatatatatataaatacagatgacctatatgaactatatctattcagagaaacacagcataaagatatattggtcccaaacactgtatttggtgttcttggtgggagtaggtaaaagatgcaagagttttggaaacatcttctaaaatacagttgcataataggctaacttctactactcaaaatgtacatcatctagttagaaactagaaccctctgcacaattttatcttgatctacttccatccatagctagctatgtctgtgtcaagaaacctttttcatttgaatcaacaaataaattggaggggatagggatgtagctcaaaaaagcacttgtctagtttatatgaggacctgtgctcttctctcacaagtctcctacccaaaataaaccaacttactactaagctctttcagatccactgagaaggatcaaacaactctattgaggcagagtaatggtaaattattttaagagttaatatttcaattatttgaaatattttgatttggctaactagatttcataaggtacatgtatatctggttatttaaaagctatgataattgatgataattgagactggaatggaaggcatttagctagtcatatgggagattgtaaggagaagaatggaaatgagactctaagacagtctgctcattgtatggttccaaaaagtatcttcatattttgatgtggatccgtaagtcacagttacaaattccctaaccttgcaaagcttggtatactgagtagaacacagggtcaaacaaaccaattcctttttgtcatttctctttaacatgaattctttgtatacctctcaaaggatagtaattccatagattctgtcctttgtcgtctcttttcatttcatcacagttccctgaaagtattctaggaaaatactaacgatgactgtcatgctagagccactcattttcatcttggtgaagatcctctctagacttacccttgaataatctcactacacaaagaatgtgacttagtacactgcaactcccctgcctcatctgtcccagggaaaacccaatggcatcattatccctccatcatccatatcaaatatgtgaaatcgttcacttgactctcctctatcccatacactatcccttctcttttatcatgctgaatctttctgcaactatagcaacaatctcattaatgcaaagaatagagacacttaggctttcccagttcatatggtaataaatgtataaatttatgtctttgcctcttaagatatgcaaagtaaaatctgaagtctacaagacccatcatgatctgtctggctgcccaatcacatccagctacttatctcaacccaatacggcccctgttaaaataaaatgctcttcttttctgcctggtaaccatctaatcctttaccacgtgtcatagtttttggatctgaattctcagtctgctttgttgcatgatgcagattttatgcatgtgtagtacaggtggggtgtagaacaagtcgttcattttaaacacgatctctggatttttctagcagtgagacctcaagctttgagatttttctgttcataaacttttttttaattttacaaatactaaacagcatagagctgacagcagtgaaacattaaaatgaccaactcttaattgaagacgaaagtcttcctcctgctcaggtcctcctaccgcaactcaaaagaccctccctactcattttaacaggtactgagggaacttctgcactataggaacttattacaaagatattgtcttacttatcaagttcttaggattaatgcaagtggtagtgaggattggtgtattaataactttatttcagaatttaccttcttggcaatcccaacttgcttggctgttagtttccaatgcctcctacgctgtaagcgtctttattggatgacactcagcttccaattgtatggcttactaaggaaggaaacttctatagggcaattttcaaaacagctgatggctaatactttataataatgatatatgtatggctcatgagaagcacctacctgaactcaagactggtgttaactgcattttattctactgtcaaatggcactttagacatgtcttaccttggaatcctttcaagagtcaattacctctcccatgtcatccagaatctaaagaccacagaataactttcaaagtatattatttcaaacacacctcactggatttaagaacagttggaaagctccaggcatatttggagaccagtatcagtaataccctgataacaaccagacaaagataacaagaaaactacaggccagtatcttttatgaatacaggtgcaaatatgctaaacaaaatactagcaaaccaaatccagcagcatagaaaatggtttatgtagcatagacaagtggggtaattccaggaatgcaaggttctttcaatacaaaattccatcaatgtaatacaacatatcaatagaataaaggacaaaactacatgacaaccttattagatacagaagaagcatttgacaaaattcaaaacccttttcttgatttaaaaaaagactcagtaaggtaggaatagatggaatatttctcaacttgcaacatctatgaaaatcccacagctaacatcatatttaatggtgaaagacctaatgcttttccactacaatcagaaacaagaaaaagatgtacactcttgccacttcaatttaatatcatattggacgtgctagccagggcacttaggcagggaaatcaaataaaaagaatccagattggagaggaaacaaaagtatttatattcagagatgcacaatcttgtataaaaaattaaaaacagaatcagctcagaatagctacagtatataaggttaatacataaaaatgaattctttctagatgtagcaatgagtaatccaaacaaatattaaaaaaaaagttgtttgtaaaaggatcaagtgaaaaacatttaactcaaaaaagccaagatgtatacactgaaatctataaaatagcattgaaagaaattacacacctaaataaatggaaagacactccatatttatggattataaaatttaatactgttaaaataccaacatacgtcaatctgatgtatcgattcaacacaagaacaatcaaaatcacaggtgctttttatgtagaaattaacaaatagattctaaaatccatgtggaatgcaagggacccagaacaggtaaaattatcttgatgtagaacaaagctagagaactaacacatcctaaattcaaaacttactctagggctacagtaattaagacagtatggtactggcataggaagagacacacataggacaatgggacaaagttcaagaatccaaaattagccatatttatggtcatttgtacgtgtttttgacaaagatagcaagcctactcataaggaaattactaatagtctttgtaacaattaggtattgttctactagatatccacatattagagaatgaaactggatccctaaaatgtaccacatgcaaaaatgaatcaaagacctaaatttaagaaccaaaaccataagatacttaaaagacagtaggagaaatgaaaacatgtacacaaagtgttcatagttgtattcataatatgcaaaaagcagaaagaacacatgtatgcacaaccaagtggacaagcaaaaaaatacagcatatcaatacaatgacaatattcagccacaaaagaaacagtaccagtacatgctacaacattgatgcagtttgaactcattgctttgtggaaggtggcgaaacagacaaaaaggccacataattgtatgactccattaacatgaaatgaccaaaataggcaaattcataggcatacgaagacgagtagttgccaggggttggagttaagaacaggcagtcactcttaatgggtacagaaaactttttacagcgatgaaatgctctggaattttataaagacaatttcacaactctgtgaatatactataaccacaaattttacactttttaaaatggcgaatttttatactatgtgaattatatctaaaagatgtgagaaaacacatctcttccatttaaaggtggacgatataaggtcaggttttagaaaataagtcttcattacagacatttctaatctctctctctctttttttaagttaacaagcaacgttgggagaactgttctcaggatgtcttccaagatgttatctaccagctgcatggtaatttcactgaaaccacacaaccagagataaggtaggagtgggtataatccaagtcaagggaatggcagtgccaaactaaaattcagagtcatttgactgaaggctacaaccccaaccagtgtgtactatattccagatacattccttatcattttctatgtgtttctgggtaatgaaaaatcataataatgatccaaggttccatgcatgtcagcataataatcttaatttgttgtttaatttagtcatgtttgtttttgcaaaaaggaagatgacaaattttaggtggtcatgtggacgcaaccttaccatttgtcatcccttttcctgcctgtatgacttttagtaaggtgtataacctctcaagttacagatatttattggctttgtgaaaatgaaggaccatgtgcacagatctttagcagtcattgaaaattcttgtcagaatttacaggaatttgagcagcaaagtataagaaaatgttaaatatgactcacatatatttacagagaacagcatctggaggattcctctatgaaaatttgagagactagtcagtaataacagaacgaattaaggtatcagttgccatgactgctggaagagtatgagtggcataaagacggtggtcaagagtacaccagaagacaggatgtagagttacaaaactgtcttgctttcaaccatctagtcttttccaacttactgtcttttttaccctggggcagatataatacagtgattccagaaactctattcaataaatgtatgtgtatatttcttgattaatgcttatctgcctactgcctaagagacagaaagatcagtacaaggtagtttccactgtgaatttactcagattccatacaaaagagaagatgctttaaaaaaaataataataatagtgggacaatatcaaagctaaaacacaggaaagaaggaagggaacgcacttctgaaggcctcctcaactgttcaaataaatatgatccaccaggctgtgaccagggatatgtaggctgctattacactatgaaggcacactgtaactaatagaagtctttatgagtatgatactttcaaaattccaactgaaagaatatgtgagttgtataaagttaatctaaaaaggaattttgagtagtgatgaaagggatgctgaacaggatgcactagtaaattatgcagaaatccacctgtacaaactattcaaaggggaagtactcatacaaatcagaaaaaaaaatgctttttgagaatgaaaagaattagaagtagttcagagtcaggaagataacctgagtaaatcaaaggattggggcctgaaataaagtacaattaaataggtctgagagacaataactgacaacatgcatatatatgcacataaactgtgagagggtaggaaacagcaaaagctatggtaaacatggaaaggccaggaaacaactttgtggagttgctctttccttccatgtttatgtggagtctaggcagagtcttcaggtcaagttttatatagtgagcacctttacccactaagccatctccccaggccaaaaaattgacagttctaaaggaagtaacaagaaataactaggagatacaagagtaagaattttgtttttatcggtactgttttgtactatataatgacttagaggtaccaggatgatgtcctggaaacacgggtctgatatgatatgagatatgagacccacaaaatatgaggcaagagaaaaaactttgggttgaacaggaagttcagaggagtacttctaagtacaatcaggagagtatccatacaaggtgtctatgagttgggatggaaaagtgagcctttcaggaagctgtagcccaactctgcaaggctctcaagggttaaaaacaagacttctttactgtggcaaatggagactactagtattattgcaagtacattttcagtgaaatattcctggattagcagcctttacatagtgaaatgcagtacatacatgcactcaaatattcttacaactgttaccaaagtcaattttcttatttgaaagtagaagaggggaaaaaaaaagggcctctgtctatattgtgtaaacatttttcctaccaaacaccaggaactgttttacactctaaagatgaaagaagcagcaaatggaagttactattattattattattattattattttattctgggaagggtagaaaggattaaaatagaccctgggataagcagttaaagaatgaacatcttaaagagtagcctcagtaaaacacttctttctctagggtatgtggattcttgagaaaaaaattctttaaaagaggttgatttcagcaatagccaccttatggaaacacggagtaatgctgcctagttgatgcatttgccacatgttaatgtgaacaagttctctgaaggctcatttataggtttcttttgatatatacattcctacacaggatgtatttccaaataaaggtaaggttattgcaaatgaatttgatcacacaattaactatagaccacgatatgtacactcaatttgtttgctgcagctgccaagtttccagagaagttttgctgcaggctgtgcttttatgccataagtttgaaatgttctacactactaaaaggtattttttaactcgtaagtattgttccatgacaatctagtaaagcaatcatgaaaaggcagccatattaatgtggtaacatgccgagaaaaactgattaggaagcaagtgagagtttttttttttacctctgaaaactttttaggatttttttttcactttcttttaaatatattgatgttacttctgtttgataatctatattatcatttgaaaactttcacacagatatagtatcacaactacttcaatactgtagtgacaataaactgaagaacacaaatctcttcatgaatttattttataaaatatacccacttaatttgtcttcttatcactttcataatacataagaagcacagtggacaagatgcccattaagatgactatagtcacatttagggggtcctataatcaaggtagcatacataccacaacagtgttctaaaggctagctcagaaaaaaaaaaaagaaaacaaaacaaaacaaaaaaacctcacgttaccttatcacaatatggaacgcactgtgttctcttttcccattaaaatatttaagccactgtttcatttagcattacagtaaataagagctctgtctcaactactacaagaaagaaaataatcctaagacatccttttccccttccaatgatttgaaagctaccattatcccctgccaattaaaatcatcaggttgatttgcactagttgttaaaacaatcaaggcacaagctcaacaggttatctgtagcttgtagtaaaatgatataccagtatgtctctccttagttaaaaatacataattcttttattttgttatgcaacaaaagaaattaacatcacagacatagaagactagggatgggaaactacattaaatatccagtaatttaagcctatttgtactttaatataggacatgaaatctttaacacctttgaagtaaattttaatttgggggatatacaatttatttctcaggagtactagttccattcatttccaggcctgctaactgtgtaaataagtaacacaaggcacagtagctgtactttctgttatgctgcaacactgatcgagtgccttgaaaaatggttgattaaacaagatgacggcaacagaaggggagactttggattgtctattaaaatctcagcaataataaagattcattttaagtgcacttttacatgcttatttatacaacaaacttcctaattttgttgcaataggcttgactatcctatcatttggccagatgcactttccccagtaaacttaaacaacaaaaacaacaacaacaacaaaaacaacaacaacaacaacaacaacaaaaacaaaaaaaaaatccctgtcctttcatatactaagaggattggctactgaaacagttcattgcaagacacatgaagacaacatactgtggcatgagttgttttaatttgttgtgctgttactaaagttctgagggctgtggttcaaacattccaagttctcccttccatctttattggttctcaaaattttgtacagaaaactctttgggggctagaacagcagtacttgcaccacactgtttccttgacttcaagtttcaaaagcaaattgttagaaaaaagttcctgatttgacttagatacagggacaaaaaatagcacatacttgaagattacatgttctacaaatggtggcaatgttttccttgcgagaatagtttcgttggtatatatatcttaaatactcaaaaaggctcaacctcaagcagtaataaacacaagcaaaagtgatttaacccttaaaataaatattcagaaaacctctctgtacatacaagtgaaagaatatgtaacactttcacgcaaaaaaataattataataataataaaggatttgttcatatatgcagctgaaatctgctgttccagcccacaatgtccccaatgaagaagggaggcacagacatagatgactactgtggttcactatcttacagcctttttgtactgggatactattaccatcaaattatccctcttatatttattttttaactttttctttttctttttctttttctttttgtttacagcatgccaaatcctttggcatatgtgatggccttcaacaatctctctttaagtttttctttgcttgaatattccggaagtaaaaggacattaaagcaagtatgagatgtaggtaacctaaataaagagaaagggaaaaacaggacaatcatgagtcattggaaatatgctcagtgttaaatgctcctattagatacatatcttgttaggacggtttttaatgagaaactacagattaaatatatcataaacattgtactgtttagttaaaaagatcagttgggtctttatcctatgaaataatgcaaaaattaaagtgatgctgatgatagtaacatttattatctattgagtttccactctgttacctattgctttagatactttaacactgaagttcatttaaatctttacacaacaaacatcttactaaacccattaaaagctgaagtcactaaacaacttacaccaaagattaaaaattattcaaacctggcttttaaagattttgaagtctatgctctgtatatagatttgaaatactgctggcaaaatgaaaatgataatgattgattataaattaattaaaattagagccaagatgtataaaatgtctaattaacagtaataaaaatatatctgtcgatgtatatcgaagtctacctaggacatattgttcagccccaccataaaattgtgaagtatttattggagaaagaatacaatcaaaagtcagaatgatttaaccctagaataagaatctagtataatgtaaaagaacagacaatcctctaaattttagtgtagccattcaaagtagactgttctataataaggctttcttaataaactatgaaacaaagggggaataaaacataacaacttgataacgtctgtacttctgtaagctccataattactttttaactacactaatttttaaaaaaattcctcaaatcatgaagggaaaatatccattccactagtgtttgctgacttagatatttcaatataacatcagaagagtatatagaggctacatgttggctctgcttgcgtgtatggaatatggtgaaaaggtttacagtgggtacaaagttggagtttgatattacctttctgtgtctgggccatttttggctataatcatcttcaattttcctagtcctccaacaggtgctctgtctgtgcctgttgtaaactgcagaaagagtcttttctgttcatctgtaaacgaatgaacaatttcccagaactccctaatgtgaaaagagaatactggttttaatttgacatccactataaacaagatcatagtactacaacattaaggccaatgtcacagtgaatattaaaagtaccatttacacttagtatgtaagttttagtcagccagattttatatcttgtaggaactatatatgggataaatattaataactcttttgctcagtaattctacttaaaaagtacttttgtattcctaatgctaagcgtgatgttttaaaatttacttttgtaaaaaatacatgttcaatatcctattcacatttctaaaacctcaatctaaaaatctatcaagatcttctccaaagcaagagaaatgtgcaataaatatatctgtaatctatgctgagaataaaattggaaaatcaagtaataaatccccaaagtaaaagtagagagaaataatacacaagataagcacagttaaggatcagaataggacaaaaaaattgtagacactggaagagcggaagaaagaagtgacgaaactttccaaagatgatagaaatacctggtgaagggattttaatttttaaaaaattgtaagtgaaaagtagaaggcattgaatcacataaagcagaaccaaatattaaagaaacagcagtaaaaggttttccttcattgagaaaccacttaaagtgactgtactatgctttgctaccccatgacatttactaagagcaggtccatgggaggaaatatataaaaaagtaaatgataaaaaataaatttaagtccaataggaatattatgaagagttcttcaaatgagaaataaggctttttggaatatgaaactatttttaaaaaagactgagtcgtgaataatataaactctaacatgaaaagtttaacgatggcatcatgaatcaaaaataaagagattaatgaattcaaacagaaataataacacttgaaaatactgaggcaggttggtgagatggctcagcaggtaggagcacagactgctcttctgaaggtcctgagttcaaagtcccagcaacctcatggtggctcacaaccatccgtaatgagatgatccctcttctggcgagtctgaagacagctacagtgtacttatgtattataataaataaatcttttgggccagagtaagcagagtgaccggagcgagcagaggtcctaaaacttcaattcccaacaaccatgcgaaggctcacaaccatctgttcagctacagtgtacccatatacataaaataaataaataattcttaaaaagaaaaaagaaaattctgaggcaaatgcacatcaactctagaaataaaagatgattcaaaaatgaggtaagtaaatgagggaagtgtagtaatttgtatttgacaaacatccaacatttctacttgacaacagtctagaaacaaaaagcaagcaaagggttaggaagtcagaaggggaaaggagttaaaacaaaatattcaaaactgaagaaatgcatatcaaagtaaaatggaaacaaattgttaattgactaaaacctttcacttggtaaaaaaccctaacaagtaaagataaatgacattaatgtagagaaaatactgtaaattactccagagacaaatgtctctcatgtacaagaaaaggcaaagggaaaggaaatctaaaaagtattcctatgattcagcattttgaaggttgaggcaaaaggtaggcaagttctaggctaggctatgctacaagcaagctattgttcaaaagaagggtgtgagggggatcaataactgaacaataaaatgagtaagagacaatattaaaaatatgattaggtaatataatgaccttgaaaatagaaaactatacttcaatattatgtgacagctggaagagagcaaaaaagttgcaaagtaacctctatgttaataagggattattttgataatatacttaaaagattctttctaggtttgttccttgacaaggccttaccagtcataacattaaatagtaagtcttattcctggatgcagttttctaataatttcttttaacaatgttttcttacagggtaggggataatgttcaagataaggcaaaatttcaaattttaacaaagtcatgtgtcatgttaaagatacaccaacaccaagcaaagtcctaagcaaggctaaagtcctaatggtaaaacacatttactacattaaaagtaaattcatgagttcataatatctgaaaacaaaaaaattaccatattatctcttcagtatcaatcttaaatatatttgactttgtcttttcaatagattgatatcttaaggtaacaatataatagttgatatgaaaaagataggaaaataggagaatgacatatgtcagatgactagataaaattatttccttaaatcaccatttttataatcacaggtgaaatcatcaattaaggaaagacaaaaaagatatacaaggcaaaggactattgatcacagcaattttgttactgctccacaatctctgtaaacagagcaaatttagataggaaaatgagaggtcaacaattatgttttgtttattttagtcttctgaaaaggagacagaattatttctctttttaaaaaaatgaggagggagttagaggaacataaatcagcaagcagtgctgcaatggatcctgctccaagtttccttaatgatggatggattatgaactggatgggtataaaaatgtacaaagccgggctggagagatggctcagcgattaagagcactgactacacttccaaaggtcctgagttcaaatcccacaaatcacacaaccatgagccaccatgtaaaggaatgtgatgccctcttctgatgtgtctgaagagaacataaaaatgtacaaagcctcaaatgacatagagaaagtatgaatatttcacaaaagaaatgtttctcctcataataagcaagagactcttctaagaacaaaaagattcagtcttgaaggtgactaaaatggagaaagaaaatcagaaaaaaactcaaaagaaccgaggaggaatgaccatgtagaaatgagcagaatgtgcttttacaaaaaaaaaaaaaaaaaaaaaagaaagaaagaaaagaaaattggacctgagcaaattaagaatataatacacgagccaggcgtggtggtgcacgcctttaatcccagcacttgggaggcagatgcaggcagatttctgagttcgaggccagcctggtctacccagcacagccagggatacacagagaaaccctgtcttgaaaagcaacaaacaaacaaacaaacaaaagaatataatacacggactgaagaaccattgcaacaaggacaggaatattgactcaaggttaagaagaaacatgacatttaaagcaatgtgtacttttaaagaagctagggaagaacaatctctaaacagagtcaactataactactaactccagagattaccagatggcgaaaggtaaacggaggaatcttactaacaggaaccaagaccactcaccatcaccagaacccagcacacccacttcgcccagtccagggaaccccaacacacctgagaacctagacctagatttaaaagcatatctcatgatgatggtagaggacatcaagaaggactttaataaatcacttaaagaaatacaggagaacactgctaaagagttacaagtccttaaagaaaaacaggaaaacacaatcaaacaggtagaagtccttacagaaaaagaggaaaaaacatacaaacaggtgatggaaatgaacaaaaccatactagacctaaaaagggaagtagacacaataaagaaaactcaaagcgaggcaacactagagatagaaaccctaggaaagaaatctggaaccatagatttgagcatcagcaacagaatacaagagatggaagagagaatctcaggtgcagaagattccatagagaacattggcacaacaatcaaagaaaatggaaaatgcaaaaagatcctaactcaaaatatccaggaaatccaggacacaataagaagaccaaacgtacggataataggagtggatgagaatgaagattttcaactcaaaggtccagcaaacatcttcaacaaaattattgaagaaaacttcccaaatctaaagaatgagatgcatatgaacatacaagaagcctacagaactccaaatagactggaccagaaaagaaattcctcccgacacataataatcagaacatcaaatgcactaaataaagatagaatactaaaagcagtaagggaaaaaggtcaagtaacatataaaggcaagcctatcagaattacaccagatttttcaccagagactatgaaagccagaagagcctggacagatgttatacagacactaagagaacacaaactgcagcccaggctactatacccagccaaactctcaattatcatagagggagaaaccaaagtattccacgacaaaaccaaattcacgcgttatctctccacgaatccagcccttcaaaggataataacagaaaaaaaccaatacaagaacgggaacaacgccctagaaaaaacaagaaggtaatccctcaacaaacctaaaagaagacagccacaagaacagaatgccacctttaacaactaaaataacaggaagcaacaattacttttccttaatatctcttaacatcaatggtctcaactcgccaataaaaagacatagactaacaaactggctacacaaacaagacccaacattttgctgcttacaggaaactcatctcagagaaaaagatagacactacctcagaatgaaaggctggaaaacaattttccaagcaaatggtatgaagaaacaagcaggagtagccatcctaatatctgataagattgacttccaacccaaagtcatcaaaaaagacaaggagggacacttcattctcatcaaaggtaaaatcctccaagaggaactctcaattctgaatatctatgctccaaatacaagagcagccacattcactaaagaaactttagtaaagctcaaagcacacattgcacctcacacaataatagtgggagacttcaacacaccactttcaccaatggacagatcatggaaacagaaactaaacagggacacactgaaactaacagaagtgatgaaacaaatggatctgacagatatctacagaacattttatcctaaaacaaaaggatataccttcttctcagcacctcatggtaccttctccaaaattgaccacataataggtcacaaatcaggcctcaacagattcaaaaatattgaaattgtcccatgtatcctatcagatcaccatgcactaaggctgatcttcaataacaaaataaataacagaaagccaacattcacatggaaactgaacaacactcttctcaatgataccttggtcaaggaaggaataaagaaagaaattaaagactttttagagtttaatgacaatgaagccacaacgtacccaaacctttgggacacaatgaaagcatttctaagagggaaactcatagctatgagtgccttcaagaaaaaacgggagagagcacatactagcagcttgacaacacatctaaaagctctagaaaaaaaggaagcaaattcacccaagaggagtagacggcaggaaataatcaaactcaggggtgaaatcaaccaagtggaaacaagaagaactattcaaagaattaaccaaacgaggagttggttctttgagaaaatcaacaagatagataaacccttagctagactcactaaagggcacagggacaaaatcctaattaacaaaatcagaaatgaaaagggagacataacaacagatcctgaagaaatccaaaacaccatcagatccttctacaaaaggctatactcaacaaaactggaaaacctggacgaaatggacaaatttctggacagataccaggtaccaaagttgaatcaggatcaagttgaccttctaaacagtcccatatcccctaaagaaatagaagcagttattaatagtctcccagccaaaaaaagcccaggaccagacgggtttagtgcagagttctatcagaccttcaaagaagatctaactccagttctgcacaaactttttcacaagatagaagtagaaggtattctacccaactcattttatgaagccactattactctgatacctaaaccacagaaagatccaacaaagatagagaacttcagaccaatttctcttatgaacatcgatgcaaaaattcttaataaaattctcgctaaccgaatccaagaacacattaaagcaatcatccatcctgaccaagtaggttttattccagggatgcagggatggtttaatatacgaaaatccatcaatgtaatccattatataaacaaactcaaagacaaaaaccacatgatcatctcgttagatgcagaaaaagcatttgacaagatccaacacccattcatgataaaagttctggaaagatcaggaattcaaggccaatacctaaacatgataaaagcaatctacagcaaaccagtagccaacatcaaagtaaatggagagaagctggaagcaatcccactaaaatcagggactagacaaggctgcccactgtctccctaccttttcaacatagtacttgaagtattagccagagcaattcgacaacaaaaggagatcaaggggatacaaattggaaaagaggaagtcaaaatatcactttttgcagatgatatgatagtatatataagtgaccctaaaaattccaccagagaactcctaaacctgataaacagcttcggtgaagtagctggatataaaattaactcaaacaagtcaatggcctttctctacacaaagaataaacaggctgagaaagaaattagggaaacaacacccttctcaatagccacaaataatataaaatatctcggcgtgactctaacgaaggaagtgaaagatctgtatgataaaaacttcaagtccctgaagaaagaaattaaagaagatctcagaagatggaaagatctcccatgctcatggattggcaggaccaacattgtaaaaatggctatctagccaaaagcaatctacagattcaatgcaatccccattaaaattccaactcaattcttcaacgaattagaaggagcaatttgcaaattcatctggaataacaaaaaaccgaggatagcaaaaactcttctcaaggataaaagaacctctggtggaatcaccatgcctgacctaaagctttactacagagcaattgtgataaaaactgcatggtactggtatagagacagacaagtggaccaatggaatagaattgaagacccagaaatgaacccacacacctatggtcacttgatcttcgacaagggagccaaaaccatccagtggaagaaagacagcattttcaacaattggtgctggcacaactggttgttatcatgtagaagaatgcgaatcgatccatacttatctccttgtactaaggtcaaatctaagtggatcaaggaacttcacataaaaccagagacactgaaacttatagaggagaaagtggggaaaagccttgaagatatgggcacaggggaaaaattcctgaacagaacagcaatggcttgtactgtaagatcgagaattgacaaatgggacctaatgaaactccaaagtttctgcaaggcaaaagacactgtctataagacaaaaagaccaccaacagactgggaaaggatctttacctatcctaaatcagataggggactaatatccaacatatataaagaactcaagaaggtggacctcagaaaatcaaataacccccttaaaaaatggggctcagaactgaacaaagaattctcacctgaggaataccaaatggcagagaagcacctgaaaaaatgttcaacatccttaatcatcagggaaatgcaaatcaaaacaaccctgagattccacctcacaccagtgagaatggctaagatcaaaaattcaggtgacagcagatgctggcgaggatgtggagaaagaggaacactcctccattgttggtgggattgcaggcttgtacaaccactctggaaatcagtctggcggttcctcagaaaattggacatagtactaccggaggatccagcaatacctctcctgggcatatatccagaagaagccccaactggtaagaaggacacatgctccactatgttcatagcagccttatttataatagccagaaactggaaagaacccagatgcccctcaacagaggaatggatacagaaaatgtggtacatctacacaatggagtactactcagctattaaaaagaatgaatttatgaaattcctagccaaatggatggacctggagagcatcatcctgagtgaggtaacacaatcacaaaggaactcacacaatatgtactcactgataagtggatactagcccaaaacctaggatacccacgatataagatacaatttcctaaacacatgaaactcaagaaaaatgaagactgaagtgtggacactatgcccctccttagaagtgggaacaaaacacccatggaaggagttacagaaacaaagtatggagctgagatgaaaggatggaccatgtagagactgccatatccagggatccaccccataatcagcttccaaatgctgacaccattgcatacactagcaagattttactgaaaggacccagatgtagctgtctcttgtgagactatgccggggcctagcaaacacagaagtggatgctcacagtcagctaatggatggatcacagggctcccaatggaggagctagagaaagtacccaaggagctaaagggatcttcaaccctataggtggaacaacattatgaactaaccagtacccctgagctcttgactctagctgcatatgtatcaaaagatggcctagtcggccatcactggaaagagaggcccattggacacgcagactttgtgtgccccggtacaggggaacgccagggccaaagggggggagtgggtgggtaggggagtgggggtgggtgggtaagggggacttttggtaaagcattggaaatgtaaatgagctaaatacctaataaaaaatggaaaaaaaaaaaaaataaagaagctaggacaaaaactaagacaaaaaatagtaaaaaagaaagaaaatgaaaacctttgaattgaacagagaatatgaagaattaatcacattaaataatggtgattttattcacactgataattaaaaaaattttttgaaagaaaaaaaaaacaacagttcgttgaaaaagaaatgcaaaaaagaacagcaaaaaggacagctaatagaccttgaaacaaaaacaaaaaacaaacaaaacaaaaacaaaaaaaaaagcggaaaactttcatatagcaatggttccagagcatgccaggaaaagaaaaattaggctccatttactgataaaagtgaacatgaaaacctatttgaatgaatagttaaaaaggggatatggcacaaagaactgaagaacaagagttatttccaataaacttaacttgaactaaaaaagaactgaagtagcactacaaaagatgaggagaaagaagggcagtagcattatgaattactaccctatgaaagatgaagagcaaaccaaaccaggagctaagtagttcaacaagccattataaaaatatccaccaactattcaagtgccccacttagatttaaagtaacaggagatttgaagcccgaaattacaaggtgattggtgggagaaataatgcggggaggagaatttggaggagattgaaagaagcttattggaatttaccagaaaatggaggaaggtgtgtgtgtgtaaaccaaacaaaaacaaatgttacctagttggttaatagctcaatttttactatagaaagtaagaactaattgatccctgatcttttaatctattaacatgttttctcccaggcatggaacaaatcatttttctcttttgtagcacacagcagcaggtcttctttcctttctccctgttacttaaagtttcttagtatagacatctattctgtaaagtggcaaaaaaaaagggggggggggaccagaggtaacacttctttttttgctttgttttgttctgttttcttatgttggcttatttcctctttatagaagaggaactaaagaacattcttctacaaatgaaaatgataatcactatgttgcgtagaagttttgtttgtcaaggatgcaaaatttatttctcttgtcaaaacctaaaatagactgtggattttccacgtttatagcaattgaaatatatatattttgaatgaataattacttgagcttttacatcaaaaattattctaacataaaatacaatgtatttggaactgttccctttgaatggccgatttttaatagtagtactatgtaattttgattgttatagtttcaaagtctttctgaagaagatatagtgatgaagtggtctatcattcttttcatgggaaagaagcatggataagaacaacaacaaaacaaaaaaagccaaggaaagattttatttttaaaaacacgtataatatataatacttacaaatatatgatatgaccctgatggatacattataaaaaaaactgtatctgtactgcatgtagaagccaagattttcaacataataaggcctcaagatctaagagaattagacataggcaaaactgacacaacttttcatttaaaattttagaagtagggctggaacttattcggtggctaaaagcaccagctactattgcagaggatccaggctggattcacaacccctatatgatggctcaattccagtgtcagggaatccaactccatcctctagcctcagtgaacactgcatacacacattgcatagactcaagtatgcaggccactcatacaaaaaaaaaataaaatcaaatcaaaaaccaaagaattgttatttttaaaagtatttaattacctattttctattgttgagttgtttcgtattttaattaactgaaagaattttattttacagtataaacatatagtaatgttattttaaaaaataagaaacaaaaataggaatcaaaataaaacacacaattttattaaatagtataatcatgaaaactttgtcaatatcaacaaaagatgaaaactataaagacaagaaaattagaaatacatagtaaaaactaaaattctaaaataaaggctatgaaaacaataactagatcagaaatgaagtttagaaaaccttaacagagaggaaccttgaaaaaatgtgacagaaataaggttcaattagaaataaattttaaaaattataacaaatacaaagaaactagagataaattcaaaactatacacaactaggaatatagacaattttacaatcttttacaaacctaaaatagaaagattaaaactatgaagattcaaaaagcaattaagttgcaccatggttcaaatatacagtattaatgggctatgggcaaagttctgctaggaatagttgttgccctgaagtgctctcctatcctttgagtcttagagaccctaggtaagacaaagataaccacataggctgaggtactgttagaagtaccagcaaaaagaagctggcaagaagctacatgaagtatatattcgccaacatgcaaatagctgaggaatagttttcctctactcaaagacaggaaggagggagggagggagggagggagggagggagggggagagagagagagagagagagagagagagagagagagagagagagagagagtgagtctcactggagaaacatgccattcttatgtgtggggcccatatccaacagttagttgaccaacacaatggcatctgcagaggttcttggtctcataatgttaattcatggtgtttctcccccccatatcttaaaggtcctctgattatgtattagagcttctagttttgtgagttttgcattttttatgagattctctagtacacaaatatgtgtgtctctacatctatagaatcatctagaaatttttctctttggttctttttcttgcttggctgttgcgttatcctaatttgtttgttgtttgtttatctttattattccttgatgcttgtttgcttccttataagagtcagaaaaggcagggagcagatgggaggggaggtgtaggcaatctggaaggggtaggaggacagggaaaacaataaatatattatatggaaaaacaatccatttttaagaaagccctcaaaaaataaaacggaaactatcatgccaagaacaaagaaattaaaacaactcatgccaacagaaattaaaaaattgtttgaattttactgacaaggcttttaaagcaatgaaagtaattataagcttattctcagaaatgaacaatgaaataatgcataagaaacatattatttaaacttattcactaaagcatacattatttcaacacaaaaattacaaatcaatgctggatgaaactatggtataactaaatggaaagtgctatgccatgcttgagatttagaaaatccaaagtgatgaaaatgacaattctcaaattgatttatccaatcaattcaacccaaatcaaaacatcaaaaataaatgttattcatgtaaaattcagcaaacagattttaatatttacatggaagtaaaattagtgaaaacattaagaacaatgaaaaagtaaagggattctcaccatctgatataaagacttgctctttgttctatcaaggtaaaggagtcatcaagatgtgattttgatcaaagaacaaatgaataagcagagaagaaccaagtctagaagtaactcacacaaaactcaatttcaacaaaaataaaattcagtgggggaaagaaagctgcagactagaataacacatgtataacatgtttgcatatgatcctttaaaaagaatacattccaaaagaaatagttcataatcagtggaaagaagagtggggaagataattcacaaagtaatggttaaaaggatggaccatctagtgattgccatatctggggatccaccccataatcagcttccaaacgctgacaccactgcatacactagcaagattttgctgaaaggacccagatgtagctgtctcttgtgagactatgctggggcttagcaaacacagaagtggatgctcacagtcagctattggatggatcacagggctcccaatggaggagctagagaaagtacccaaggagctaaagggatctgcaaccctataggtggaacaacattatgaactaaccagtaccccggagttcttgtctctagctgcatatgtatcaaaagatggcctagtcggccatcactgcaaagagaggcccattggacacgcaaactgtatatgccccagtacaggggaacgccagggccaaaaaaatgagaatgggtgggtagggaagttgagggggggagggtatgggggacttttgggatagcattggaaatgtaattgaagaaaatatgtaataaaaatattttaaaaaaagataaatacctaaaagacagctcatgatcctgagtcatcagtgataagcaaatttatactaaggtaaaattttatttcacactccaagacaacatgaccaaagattaaaagagatacagaatacgttctagcactgcttgtcatcttaggtaaaatggcagtatcattttacaaaagcattcttgcagtgcttcttaaggttaaaaatgttatttacttcacaaccacaatcctccaaagtgcttcttcaggagaaatgaaaacacttcaacactaagaatgaaaactttatttgtaacagccccactgtcatgataattctattgccaataacaaaaggataataatcaaaatgcatacattaatcataatcaatctaaaacattattttgccatattgtagagataatactaggatattcccattaaggcttctgtattaccatgtttatccctgttatgaattacctttaaaactgagcagcaatataatggttgccacttttgtgactggtgttagaagcaaatatgaatgataaatttttatattcattaataattgccattgtgcttagaaatgatatatcatatgacatgttatggtttttgttttgctttactctgaattttgttatttaattacctaaaagctgaataaataacatatttgcttttctattaaaaaaaaaagggcaaagcaagagtaatcttctacaaacttaaatgaataaagtaatactgtaatataaatataacaatgataatgtatcattactagacacagttaatattcattctattgttaacatatttgagtcttatagctcaagtgatctacaaaaagataactgtttaaatacctatgacatcatagtggatgccaaaaagactactctgcattttgatcagtcacattagaagatggggggaaagatctttcagaattggatagtagcatattacagaagtagaaataagggcatttgactagagaacgatgttagtggtaatactgtcctaagaattgttcagaatcactagtatacatggttcttcccaagtatcttaaagactaaataatgtgccatcttacacatgaccaaaaataaggcaaagggttgagaaaatatgagacttaaatcatttaattcatgaaataaagcattagactgcatgaaaattggaaatattaatacaggtctatttttgagcttacttgtttggtaaccagtacctacagatacaggacacaaaagcacacatctacatgtttgatgaataaaatcttcctttttaagaattaaacaccttacctaatcacaacagattccctcgtatagccaccgtcatactctgtagtttcttctagtgcctggaaatctagattctgaaaattatagggggaaaaaaaagcaccttaacatccatagtacaccaaaacaaaaaacaaaacaaaacacccaaaacaaaaaaaaaaacaaacaaaaacaaacaaacaaaaaaaagaccttttttgtatatgtctttcttacccggcttccacatataagcaattcaatttcttctggtctgaataagtattttaagggcgattcattagtcaccatatgaaaacctctgcgaaatgccttgaattgtttttctacagatttattgagaatgtagtctgaatagagattgacaaattcctgtaggaatattaacaagaaagcatattctatacaaatgaaacacaattagcttttggactagttttaatacccaccctccaccccaagaaaaccttcagcagtattttttttgttactatgtttaaaaattagatttcagagagttggttcagtgcttaaaaaagcattagcaactcttgaagaataaacataagtcttaaaaaattaatcacatgttatatgtacaaagaaaattattttcacaatttctcacttctgacagatataaaagttgtattcatatgcatagttatacattatgattctatgagtaaatcaaagagaaattatataaaatgtaattaatagtaataataatgaaataatgtaaacagtaagattaaaataaaagatttaaaaagactgtatatatatataacaacagaacctctagtatgcaatataaatttgttatgaatactgaacttgagaaaaccagaatgtctcaggtttcctctggaaattatggtactggtaagttagctactgtatccagctcagcaaaaatgttatttgttggtaaactaagctattataacaaattataaaattttatagtttttataactacttcaaaccatactaggtaattctttgaaaactttacaaattataaaatttgttatagtacaaatgtagtttgtatcatgacagtacaatatttcaccaaaaataatagtataaattaatatatcttaaaattatactatgtaatattttcttttgaagctaagttatttcctattgccaagtaaatagcttttaaagttagtaaaaaccaaatctaatgtgaataatctgatatgcataattagatctcatgacagtacaatatttcaccaaaaataagtataaattaatatatttcttaaaattatactatgtaatattttctttttaagctaagttatttcctattgccaagtaaatagcttttaaagttagtaaaaaccaaatctaatgtgaataatctgatatgcataattagatctcaaatggaaaatgtatatacacactaaaccagatgtcaatcactgggctctgtatacctcttaggtttaatatggtaaggccctgtttctagcgttacattatagtaatatttacccattcaatcttttgtagtctgtttagtctttctctaaaggggaattaacaattctgtacaatcacataagctcttatctaagaggaaagtgtagctttactatttagataaatttgtttatgtaaagtttttataactgcttcaaaccatactaggtaattctttgaaaactttactgctttgaaattatatatttataaaacaatgacaaaaatttaattaccttcctgttttcatttgtaattggaattttatcaccattttcttttagatcatacatcattgggttaccaaaaagatctgtctgtgatatctggaaagtgatcatcatatcatcttccacactcccttcatattccaataaatcctttaaactctgatataaaacctaacaaccagaaagagaagtgaggttgccaaataaatactaaaagaaataaaaataatagattgttcattctttgtagaaacaacttgtcaacaaaaatgaagccataaatattccacatctctcaagtagtttaataagatagaaaggttgtcacaggcaatgggtcaatcttaaaaattcttcaaatgatcagttcagcaacagatttcataccatggtctagaatatacactttctctccatgattgtggcagggtacaggaaatgaggaaaaacaaacaaacaaacaaacaaacaaacaggaaaacaaacaacaaaaaagccacacacatatcaactgtacctatcaacaactttactacatagactcatatgggacattgaaaacatgatgttttcaacattttttatggggtcaatcaaaacatacttgataggatatataaaaaatgatgtttattatacttaaccagattaaaagtattttactttactaaacagcagtatcaacaaaagtttacaaataaataatgttcctatataaactgagataaacttctgtatttagatacaatcttaaagactattaacgaaggacaacttactgggtgagagtctcccaagtcacgaaaggttccttttttccccattagcttcctgtatacaaccatgggaaaatggacatccagtatacaattattgtaaatagccagacccaggactatgccaatcagagtaaactgaccctcagtttcaaaagaagatggattaaaccaaaataatttcgtagcttcatcatatgtgaacatacctataaagaaataattaaaagtcattttatccacttaatgactgaaaattacatatgaaacaaatgcatgattaagtaaaaaaaaaaaaaacaattggagaaagttgattaactttaagttacttaaaattcatatcaaatctaagctaatataattttaaaaaatattttgtgatctttcagcttcacatgatcttcattattcaaagccaaagtccagagattttttttcctatcatcattattttatctaggtgaacattaagagatagtcttttttttctttttttacggaacatcaaacaataaaataaaacaaaactaattgtatatgcctttcaatttttctaagtttattttcagttgcttctcaggaaatactttttatacaaagtctaacaagctgggggagagagtgggctgtataccttagcacttggtaaaatgagtaaggaaaattatgagcttaaggttagagtactaatacaatataaaaagattgtctaaaaaagccaaaatcaaaatgagcaaatcaaaaagttttgggaaatgtttttctaatggaacaagagtattaaaaaacaaataataaagcattaaaatgtactttcaggttaattttaatatttaaaatgtttccttattttcactttcagttttaattaaaaagaaaagtacacttttctccttgaactgtagtaatataaattaagtctaagctttttcttgcaatttaatatttgtggaatactggtttcacaagtattcaattcatacttgcattccagcttgaaaaatgtgagttatgtatgtctgtatcatttgcatgccaggttatacatccaggtaatatcaaaagttccagttcacaaataataaatctgatagaatgtcaccaatggatgctcttggtctcaaggacaattaagctataaattaaccagaggataaattatataacctatgattctcatgacttcaggttttcaaatctaccactctaaggtttttcaaattaaatttccctagaaggcaactgtgttctactagaatatttgactaagtaatatatggaagaacctaaattaagtgagtgatagaacagctcctgaagcagggatatggcatactcaatttttttactgcttaccataactgaaaatatttataaaccaagtttatactttaaaagactaacacaccatcataatcatatcactaatacttaccaatatctggattaaaaatttcctccacaaccaactgaaaaaactctttggaaacgcctccctcatctactccttgttctccttcaaattccacatacaactgcttcttcaagtctgcaggattttccatagcaatcatctctagctgttgattgaaaatataaaaaagaggacagttgagaagaggaaaaatgtaagatataagtagaagaaaataagaagcagcaataacaaaacaatatggaaagaaaacaatgaattttgtttctgaaaagaaaaaaagcaaactgacttacagtttttggcaagatttatttcaacacacaagagtatgtactgtgtttaagaagctatgcatttcttagtaaaggatatagccaaaatgctgttgggggtggggtggggggaatagttgcaattatgtcctgtatatcttcatctttaggggtctaagggcctatgaatttattctgtaaagaatctctatattggtctactttaactaatttgtatgtcttcatgtatgtatattcacatgtctccttccacctaagatgtatttcctcaggatctgtccaccttgtttgtcaggaaaggatctctccttgacctggaagactgcataacacaataggttggactgtcaatggcccctggcatctctgccagtacctgcctacctagcatcaggactacaatgcccacttcaagtttcttttctttaatagagttctgaagattaaactcagttcttcttgcaagttgatctaccttctcagctcgcatacccaattttcaggtcagtattcattgaaatttattttcagcagtactttgttggtgaacatataagaaactgttctttcacaagttccacatatcaccactaaatattaacatttaattactaagcttcaataaatcaatcctattttctaatgtattacagaaacagaggtaatattcttcctactctaatggtatatgcttaatatatcatttctaaggagcaaaactgttaacatattacccttcaaaactatagacttttaaaattcataaatttatgtccccaagaaattaataggtaggtctgacactttacagccaaatatatagatttgaatttaaccttagaaatggagaacaaaattataccaacaacagcattagctagaaacctgttctaagacagaataactttgtacacttaaatttccatgatcatcttagctcaaatttggtcccaacacaatatactattattactgtggtttctcccagttctcaacttgctaagaaaacatgttaattattgattcaaaggcttgttggtttcaagacagcatacatctgtccagtctctacccttttcccccaattctggttctagtatgttctattatgatcactaaaaataattttctatatttttgctttcgtttgaaatgtaaaataagcataatgagatagtatcaaataaataagtgaagtgtgtaaattaatgctctaccattaactctaagtttgaagttgcaagtattgtcattctagtaatttttaaatattccatgttttctatatatgatagaacaagcatttcatcccagcactcaaactcggtaagtttagtgcagttatgtctacacagaaaatctgagtccagtgagagctttatagtgattctctatctaaaatatgataacaagtaaataagtatttccagttttgctagaatatttaaccacatgattttaaaaacagaagtattcccggaataagagcagcagcagcaacaaattatgaaacttacagctcactttacaattaaaattgttctgatatctacaactccttagcaagtaggctgctaaaaccattttacagaaagtcccttgaagtaataaaaggataaataacttaagaaatagtaattcagaagagaagttttaatccagggagcaagcttatagcccacagtttacctacttttccaaagaaaatagagataatatttgcttttagattttgtgtgacttctttggatatcaatattttcaactatattcacatattattttcagaatcaggatatatttgtatataatttaaaaatagttggcagcttaattctgtaagtgaaaatgtccaactagcaatttaagaagaccattctcaatgttgccaaagtgactttgtaaattcttattttgtttgagatgatgcatcagtagcctgtctttttaaaaactatggtaacaaaacaaaacataaaatttaatactaaccatacacaaaagccattagcaaagaaagtcacattatttttttttccttaaatatagtaactcttgctgagaggtggtagcacaagcctttaaactcagcactcaagaggcagaggcaggtggatctctgagatctagaccagactagtcaacagagcgagcaagttccaggacagccagggctacataaaccctctcaaaatacaacccgcccaaaaatgtaactcttagaagagacacacacacacccttaaaccattgtttcatcaactaaagaatagtataaaaaaaaaaattaaagttatattttaaaaatgaatttgtaaaatcaagctgtcttacatgtaattggatacatgaaaactattgggatatacttaaaattctgaaaaaaatataagacaaaataggtagtattggcttcatagatagcgctggagaaaaaatacactggtattactatgctgtattaatgtacaatagtaactatcacttcctaactgtacttctcttcatactaggaaatctcactctcatcaactgttaaaatattattcttaatttatttggcaatacaaaatcctagagagatcattttttacaagctgaccttataggagagcattccaagaaatctaagcagaatgatatactgatttaaaaaaaaaaaaaaacattctataaccatatcttcaaggatcaaaaaaaaatttagcgccatcatttaaaacctttagacagggctggagggatgatgtatcagcagttaagagcactgactgctctttcaagtcctaagttcaattccaagcaaacacttggtggctcaaagctatctgtaataggatctgatgctcccttctgatgtgtctgaaaataaataaacatgaaaggaaggaaacaaggaaagaaggcgggcaggcaggcaggcaggcaggcaggcaggcaggctaaataaaacctttagacatccagagttaccatctaaaatcctatgttaacataactgaaaacaaaaaactactaatgatactatttaagttgaacaacactcaaattagctctatttaaaaatgtttagactctccaagaagagtaatttatacactttgataaaaatctaaatatgactttcatttctataagtaaaaatctctctaaatttctttcttttaaattattatatgatgctaagctcttatcgtactgactacttcatctcccattctggttgtaagaaattattttgaagataaagggaagaggattccattaatttcttttttttttctttctttctttcttcttcttcttttttttttttttttttttttttttttttttttttacacgagacagggtttctctgtgtagcccaggctatcctgaaactcactctgtagctggcctcgaactcagaaatctgcctgcctctgcctcccgagtgctgggattaaaggcttgcgccaccacgcccggcttccattaatttctattagaataattttaaataagagaaatcacattaagtacaattctattaatgaatgaattacacctagagcagcacagaaaaactccattattaaagcaatgtatgtcaaatgatttttttaaatcaagttcttgttgcaataggtatttatactaagagaaatgatggaagctcagctagacaatgcatctagactttcagagaaattgaggaagtaattcaaacaactttttcttcatcgatgtgtgccagctcctgggtttttggacttttctttccaattctacaacttagcaattatttttggttaactatggaaaattctagaacttaactaaatttattcatgtcccataccactgtcaactcctattttagtcacactgacttcattattcgttttaaacactggcaatattctacacatggatattattcaataatttatacttataaactgtactaactgttgtttcccaaatattgatttgtagcatagatgtaccaaaacatgtaaagaacagaccactacattttcatatcagaattctttttttttttttttcctatcagaattcttagtctgaactcctaaaagtccagaccttaaattctgttgctgtgtttttattttctgggcaattctgcttttagattgtgaacgcagtctaaagcatctcgcacatggcaatactgtctctggatacatctgatcttattccactttttaaaaaaaggttttaagattttatatatgctatatccttgaaatcactttattttttaaaaagaggagaaaaatgtgccatttatttgctggtggtagaagaaaacatgtgccaaggagttaattacgtcttgtggattaaactcagtcatcaagcctggtggcaagtgactttacccaataaaccaacacaacagcctacaaagaatatctgttttttgtttttttttttttgttttatttgtttttttttttttttaagactgttaaaacttctacactaggattgttgttcaaatggaagctgggatctcattagtatttatatctgtataattttctcgttaaaaaaaaaaggccaaaaccattcaaaataaagcaaaagaaatattggagttttttcctttttagtagaatttgtagatttatttctttattatttatttattgcttagtacatacaaattttaaaaaatagtaccttatacttttatactgactattctcttgtgagacagatcttctaaaaataacagttgggggaaagagttgttatactgattgaaaataatgaataaacttttgcttacaaaaaagaattggctaggagtgttatacacacataattttagcactcaagtggaaaagataaacaagatcagaagtccaaggataggctaaacattctttattaaataaaaataaaaagtgatttccaggacagccagggctacacagagaaaccctgtctcgaaaaacaaaaaacaaaaacaaacaaacaaacaaaattaattctaatttactcgcctactgtctaccattaagccagctaatctaattaacactgaaatgtgagattcaatagaaaacttacaaaagtcacatatgtaatcttttctaggcctcacttataaactaaggagaaaacggtattatttccttcatagctcaaggttagggttctataacctttctttctttctctctctctctctctctctctctctctctctctctttctttctttctttctttctttctttctttatatttattaatgttgagttcactgcaaaacttctcattccttctctatacaaccttactatgcagttcaaaatgaccgggtcataaaagattgtgattaacatgaatattctgccaagtttttttatgaaagaaagaacaaggtttcaaaacaatagggatttgtggagaataaagacgtggaaagagagtagaattccatcagttcatatgtgggtattcttttgaatacagcttgctgtaaacctccacctttttgctattaatctaatatgaatataataattatcctttgctcagggtcatcaatttgatctctaaagtctgagtctttgcttctatttctaaccctttcccactagtatgctgaaaaaccaagaaattttagaggggttcagttgaaaatgatccagaaagagaaaaaaagaggagaagtggaaaagaaagcaatataggacaaagaagagctgggtgaaactcttaggaattttctcaaaaagtacctatctttgtaattctactgcttatcaatgagacaaacacacagaattgatgaaggccagggcttctataaaatactactagtcgaatatggatattatcaaatgaatcatgtcaaaccatatgactagttcacataaataagatttactagcaacagtttgttagcataattacaagactcaactgttaattttactccaactacagaaggggctaatttcgtcctaaatgaaattttacaaatactatccaagttttaactggttcttaactcaataactttattatagaaaaaaatagtataagaagataataaaaaaaaaatcaggtaggacaggtgcataaattttttattaaatgtgtatttagctcagtcttaaggcttttcagatttcgacaatccattcccccccaaaaaaaataaatgttcaaataaatattatttgttagttatctgttaatgagttaatattatttgttagactataaggatgatgcttcaatctgtaactagtactaaatcttacatcaagtttatacaagaactagcactaacaggaacaattaataccaagggataccctgaattacttatatataattttgttaatatgtgactgacaattttcaaaccaaatttctggtttaactgacagggactctgtaatttttgtcgtctgtagaaaaaaggaagacaagaggcaatgttatttgaaaacaaaaacaaaaatcacgcagtaagaagttcctgacttcccagttaaatcatctagatttacctggtattactaacattaattccaagctcccaaaatagccactttacagaattttcaagattcatgttattattatttaaaaaaacaaaatcctacaatgtcacacaagacagagtggcttagaactccaaagtcttattgataatacagactaacctttcctggtcatatcatcaagttcacaatagaaagctgagttgtgttacacataatggaatttgaagagcagctcttattcttttacaatgtacatttattgcattatttcttccaattccatcttccattcttaaaaatgtgtataacaataccatttgtcatgtgttccaatctttgaaaaccaatcttttcttcttaatggaaatatatgaggctggctttcaagattcagaaaatccattccttttacttgctttgtgcctgtctgtctgcgcatctgtgtgcatatgtatgcatgcatgcatgcatgcatgtgtgcatgtaaatgccaaaaggggaaaacgtatgtgtggaggtcaaagaacatcaagtatcagactttgctttctaccaactgagacagggtctagttatttgtcagtttatatatcagattagcttctgaggatttttctgtctatactttctatcttgctttaggcagtactattacaaatggaactaccatatcctgttttacatgtattcagaaaatccaaggataagtcctcatgtttgcacaacaaacgttttaaccactgagtcattcccctagtactagaaaaatctattcttcttcaaaagagaattatcattagacaaccaggataccagtatttttggtaagaagcaacaaaggtgtagcaatacagatcagaaatgttaacataatcctatttttttccaaaattatagataaaatgaataaattgaaatacatcactgtctaggttttagtttaattccaattttaaataatagtcaaacttacccggaccagtgcatcatctataatatggtcacgtctgactttgagtctcaaatacggattcaactgctgtccttgaactaggctgtaaagaacagtgattcttctttcactgtacatgcgaattctattgtcataatataatcccagattctttgtgacagcattcaatataaagggacatgtcataaaagagaatttgttctctgtttcaactttgaaaaaggtataatctttgtccatttctagaacatcattcagtggttcattaatgaattcttcaaaggagataagtggttttcgacagtctagagttttaacgccaagttcggtttctagtggatccactcgaggacctttcttatttcttctttcatctcccagaagctcctgaagtgttaattcgctggactcaggtatgggttcttcatcatcttcctcattatgatttgtgtccacatcccctcccactacatttgcatagtaaaccattttcaaacactttgaagcagcaacaatggcatcatcatcattcactagatttcggctattaaattcattgcttatgactttgtaggtaataagttgctgaaatgtttccatcattctccgaatctggtcagcactgtatttagaccacagcctaatcagttttccttgagcttcaaggggtagcttacacatagctttgcaaaataatggcaacgccatttccagatattcaggactgtggagattactattctccattacaataatgaacaaattgagataattaggatctcgagtatacacattatgatatgtcaaatcacattccacgttaggtgacagatatacaagtgcattcaggaaggcagtttctaatttttcattagcgagcaaactgctgtagacccttctaatagcatcaatatccacagtcacatcatcaggacctaatttttgtacattgttgtctccctgtgaactatcacccatccttgaagaagatgcttctgagtcttcttccatagcagcagcagaacatgcagctttttccttttcatcttcatccttgtcttcatccttttcttgaagagatttcaattcctcctttgtgtgctgtttgactttccgaaagctcagaaccagtgcctcagcactagaaaatattcttccaattacacgaattaaaggggaataatcctcactctctctacaaaattcataaatttcatatactttctcttcagttaggtaaatcacatctagaaaatggaaagaaaaagaacatttatgttgtaatatacatgtttattttgttaaaataattgctagtgaaaaagtaaaatatctaaacattctggacttgatttagaatttttaaatgatgtaatttacttattaacaagtaatcccaacaatctcaccctttcttggcattcattgaacaaaatataattattaattatgcattgataattaagacatgccttgtaaccaagacatgtactggtatgtaacattaattgtaggtatgaacaaatatatatacttgtcatttcctcattgtactttattacaaccttaacaaaaagctactatataaaatcctgaaatcattttcctttgcattgttctcaaaaaactaaggaggtaaggttttataacaaggtttccttagccccttcatttgcaatcaactctttctatacttttgtatatactaaaaccaaactgactcatcttatgtattcctaatttcttccagaatttccattcagaggctgaggaaaagatattactactcatgtaaactctactgaagttaaaactgctactacaactactactacctatgaccattactcaggttctaacaattcttaacagagcaactggaaattattacagtcatcagtcatttaaaaacaaacagaagaaagaagctaagaaagcaaaaaccacaagcactaaaacctatatttattttctcccagaaatagaattgggatcataaaagtctctagcttctcaccactaggccaaatgtaaatttcaacaaaggctttaccatttcaggttaacaaaacaaaagatacttatctttttggaaaaaggtaacattttacatattaaagttttagaaagtaatatatttatcaaataataatgttgaaaccactaatctctttcaccaaagagtaacatattataattattaaacatttaagttaggataattttatggttacattgataatacacctcatacattgccaatatatctaacatgtaaaatctttattatgattgctacatattattaaaggtacctaattcaaaaataagaaacaatataaaattcaagtcctcattgatggaatggcttccaaaacataaaccacaaagcactaaactatatatactacaaacctgtctatggcccattctagagtattgatactttttaattttatgatcttcaattctttcttttaaaaaaatgttctatttacttattagaggtgatgagggtattgagctgagttgataacctaaaagaattaattttctccttctacagtgtgagtttcagtagttacatgtccctatctgaggcagcatggcaagccaagttcaattcttagtctactaagaataagtaaaaaagaaaacactaacatggagctcatttctcgttattctaactgaaaaaaatacatggaatcttctttaaccattcaagtctaccaaatttctctaaactgtaaccaaaacacagaaaatatcagtaatgaataaataggcagactgttagaatataatgttttatctccctatcattgaattataaaattagttagaaagtgcaaattctacatacagaacaatatacatcctgcctgaaagagaataaagctctagatccacacacctttgatttgcaatgtcttcctttcagagcacagtcattaaatcactctgacattctagtaatacaaactactattcattgatatttgttccacgtagtactctacttaaaatgtttaaaatgtttatctccatctcccccacccctctcatgtgtgcatataaatcactgcaatcagaaataaaaagttctaatctgggtatcaacaaacagttaagtaaagaaactttttttttttaagattcacctgtacattctaatatatgtgtgcttgaaaactgtttgagacatggtttcacatagtagaaacagaactggaaatcagctcaaaatctttaaaacataacattttatactccaaacagtttcacgcaaaaacagagttgtgatacactagctgataactacacctctaactaaagtgaacaaatataattatcaaactgagggaaacatgattaagcatatataattcaaaaatattaaagaagtaaaggcaataaaatttggagtgatccacaaaaacaaagaacctgtaaaaaaggaacacccatgggctaaaacaaggcaactatatccattatatactagatttttcccacagttagttgcattcaactatgatgggatactatttttcatttactgttactctgtcatgtccactctgttgtagaaacatgtataattgagccaatgcaattttcacattcaaaatattgattagcattcacctacttatctacaatgtaaacaaattcatgaaataggactggctatatatttttgagtagcaaagctgaaagtttttttttctgatttttctttagtcctattgtgaaagtaatatcatgaagttgtactataattttatttcactaattcatttaaacatgtttcaagtgatagtggaactaatccctggcaatctgaaacattcaattacttccattaagagaaaaaaatagattgaacaaaatcaatcatgaggcaaagtaggaaatttgaagaattttcaaaatatagaactatttttaaaatactagatgcattggggacatagcttaatcgtgagtgcttatttttcactcatgaggctatcctcagtaccaggtatcagagtataaaactttaatttcattactggggaaatagaagtgtgagtattaaaagtacaagaatagtgccacttaacttgcacaaaacaaaatgaaacgaaaccccacaagagctgagtaaagactattactggtaagttacgtccctaagcagtatgaaaatatctaattcctgacgtagagagggcagaatgtaagaaggaaaaaatgtaattttcagataactattgcaaaattttaccctgctttcttaaaaaaagaaaagaaaaaaaaaaaaagactactttacactttatatttgtatttctccttttaccacagtccctggagttctagagccgatactaggtattcacggcaaatgcaatgtacatagtagatttttgtgacctaataaggtattagctacaatataaatcattacaaactgagttcaactcatcatcatattaatttttagagtataacttgcttctgactgacaactaatgaatcagtaaaatataagaataaaatgtaaacaaactaaataccagtcctttaccacagtttaccagaaaaggtgacttttactatattatagtgcgataacttaaggtgataaaaaaagcaaaaacaaaaataaaaacaaaataacaacaacaaacaaaaaaacaaaatcaaaacaaataaacaaccccctccacatttaaatctgatatagctttcaattaaccattttgaattgaaatataatctcttacctttaaaatcttttccttccttcttgttcatttttatctctgagttgttagatgcaccttttgagttctcaaggtaagctgagcttgctcctttcttggagggatgaggatcacagagttttgcattaattttataaagctcaagggctttaatagctgctgcattgttatccatacgaagaaaagttggacaggaagcacaaaactcattcgtgcaggcctcatttccacagccctcagttaactgatggtagtagcgttctattagatgctttgcagctgctcgcttcctgtaccagacattcaaacaataagcacatttattagtatagctcagaaacaaagcccaacagataaggcaaaagttagctaagcaataaagcaataaactaaatatttagatgtagaaactggaaattcactactacctcccaaagtgttagtaaaataataaacattttctaaaaaaactgtgataaactatgtcagcttataagataattttaatatggcaggcttttctttggtttaaaaaaagataagcttaagttgatggtataggacccttaactatttagcagaaaacaacaaaaacaaacttcactgctacatctccatggcagtttcccttttcactaatataaaatcactaattcattttaacagtttcaaatacttgatttccagttaatatcaaacttctagagattaaaattttttactcagtaagtaatcatgagatatttaaaagtgctttataaataaactatctaatttcatattataccgagagagaagcaccaaggcatacaaccttgagcccatacttgtcactatcttcattaaatccttgtcataggaaagataaaggtttaaacttccatcaggggaaactcatattcatcttacttcatcaactttaaacattaaaattaacatttgattaacatatttttcatgcaaagtaaccaatacaattaaaggaatgaattattttaccaaacaagaagttgttctacataacctaaattctataatttgactctaaaattctattcttggagattaccacaaaatttaagttgaaatgtatatctggcccataataatgtcattctaaggaatccgtttggttctatacaagcatgggaactgcaagtagaaagaatctatctaatttcattctaaaacttcatgtcattattttagatagaactaagtgactaatggcactagagataaacaaatatggcactgataagtgactttaggactatgtcattctttgtatgacaaagaatggtatgtcatacgatcctaactcattcagatacttatatttagaaatattccctgtatatttaccatgcatagtgtacaaaggccaagcctgatgactcaagtttgatccctgtatccaacttggtgaaaggagagaactaattaccacaagttgtcctctgaactctaaacacaccaaaacatatgcccagtcacatgtatctacagaaaataaataaatgtgatgaagtttaaaatgtatcacgaagttagagataccacttatgagaaaaattcatcaaaaggaagacttatttccctattatttatggaaactcagcatgcttaacaacagcaaaccgcttcaatatactgacagcatgcaccaaataaaataattaccaactactttaattttgttacttccttaacaaaagctagtgatcaagttataaatgtaggatgaatgtttcgaaatattaactatttttctaaataattgactgagttaattcttcctagctacgttttttctgtaagtatgtacctaaacactaaaaatttctaagtatcagtacggaagttttaaaacttcatctacgtgatttaaatagagccaatgtttatgtttatatccaggatttttaagcgttaatttcaaagttcaaaacactagttttctaagagtactaggccgcccccccaacccatacacacacacacacacatacacacactacttctttatgtgataaagaactctcaatactgaagggagaaatgagaccatccaaaagtcagctcaatgtaattagttgaatgaactaattttctaggcctcattttaccaccttatgtccttataatttgtctagctagcactctctacatgccaaataataaactcagtacattgtcaggtactctgattatcatatgaaacttgaacttgaagattatcttctgtctacagctagtaaaagagaaagacctgaaaagatcaaatcttataattgatcttatgctatgtccattaaagaagtcaggacaattttcagcttcagaattcaatttatttccaatcactgttttacagattataatttcagaagaattaattcttaataccagcagtcctaaaaagttttaagggggaaaaaaagacctaagtaatatataattagaaaacaaaatcttccaaaaaattccaatctaaacttaacaaccatgtgtactatctgggtacagtatagaaactcctgaataaattatatcactatacttaagatatcggtaatttattgaaaatggatatgctaagcactttataagaagactcagtctgtaacaggtagaaattcacaattttgaggccagattgtttgggttcatgaacagtttctgtatctgagttaactacttatttagtctctttctgtgtctcagcttcctcatccttaggatgccagtatatttcagaattcaaatgatttaagaattacaagtgtttagactatttcagtaaattttggaagaggtaggaaaaaaataggaggtgaagatgagcaaaatgcattgtatcatatatgaaatcctcaattaatggaatagtatgtattacctgctacatgctaggccctaatggtaagtatcagatgctattgcaattgctataatttctatcatttgcatgagtatatgacttggtcaagagaactccattgcactaaatctgaaaaattaaaatctaggcttaattccaaaatttgaaattttagcattactaaaggggagacagcagagaaaatgtttgaaactgaccagcttttttgcaccaagttacaagtagtagcccactaatactaataattatattaaattaaataaacagaggtcataatcaaccatattaagttgactaatttgattaatgtgcgtttattaatattaagttaattaaattggttaatatgattgaatatgattaattaacaataataagctattcttttctcattataaatgataccattgaatgccaaatgcagggcatataaattcattaaggacatgtaaaaggcctctaaagttggaaacatacatactaataatagcttttgataaccttccaatgctaatccatacataggactggtcactaaatcatacctcatgtgtcaaatctactttttttacagttgaagtttagaatattttatagtcttaaatcattaaaaaattatattttgtttcatgtgtgaaaattgcataaaacttaaatgtctatgtccataatttctaatgtaacatggtaaatttcaagtacttgtatatttcctgtatgttctctatcataatgtatctagccaaaagtaaaatgctttgtcaccttaaaatgaattccctgtgcatgccagtgaaactttcaaccaatcatctggcctccttactttctctctttgtcctcagaagatgaatagagtaaggttctttcttcctacttagtactttaacaaaaagggagtggggaagtaggaaggaacataaaagaaaaaccaaagtaaagttcaggaaatgaagtgaatccgtttcctgatattcataaccaaaactctacaaaaaggaggtagcagttacttttgcctattcatattccactgacttcgtggaaatcaaagtacaatatagtgagtccttaaataaaaatatgccttttttatttagtttataagaatcaagtgaatcctaccagtaaaagtgttcctctttaaataatagtttccacttctttattactttctaagaagccattaaaacggattctacggaaactgatagaagcagatgcagggacccacagccaaacccttgaagagtcctgctgaagaggggaagggagccaaaggacaccacaaaaacatagcccacagaatcaactcagcagggctcataaggggttaacagagactgaagcaacaattggggagtctgacctgggtcttctgcatatgttatagttttgtatagcttgatgtccttgtgtgacaattagcagtgaaagtaagggatgtctccgactctcctgcctgcttttgagaactttatcctcccaatggcttgccttgtccaccctcaatgggaaggttatgtgtgtgcctaatcttattgaaacttgttgttatgccaggtttggttgatattcatgggaagcctgctctttaatgacgggaaagaagagggtagtggatctgaagcatgagggaagggaggaggaaagaactgagaggagtgcagggagaagaaaatgcagacaggataaactatatgaaagaattaattaataactaattgatgttttccacaaatgacaataaagagaaataattttcagtgttctcagtagcactaataacattatttgctgggtcctaagttaatttcgggatagttgaatacttaggaatagtaagtaaatcataataaaaatgataaagttataagatattcataactatatatagatagcatcaaggagattatacactagaagaataaagaattcccacatagttcagcatgagaatcaaaaacagtgaaatagctgccatgaaaacaagaaacagaaacatgaaagagataactaacaatatgacttattcaaagtatcttttttaaaaaaataagcagaataaaaacaaagattggacaaaagaggtaagaaacatatacagcccaagactcaattaacccatgcataatctagtaagcactgcttagtgtctttcataggtaaatgtctcattattttgtaaggggttttataaaggatgtacctttataaaaatcactactcctccaagaaatggtggcttatgcttataatagtagcatatactagactaaggcaggaagatcttgagtttattatgaactttatgtggaggaatcagtaaaccaaatttcacaacttgccccaagttatttttaatgtagaaacttgtcaagagtaaaaaatgtgatctcacaaacaccagagatattcataatacagttaaaaccagtataaggtagggtctattgaagtgtcatcaaatcatgtattacaagactgaaagtacaaatatgacccaattagtatcaggaaccatttgaaagtcaattatatataaaataaggaaaatttcttaaagacagatagatgggtggatggatggatactaaaaatgcttttattcatctttacaacaaagtactagttgtaaaaatagaactgtggaattaaattttcacatagaattatttatcttttaaaatgaataaaccactgtttttggggttttttttttgtttgtttgtttgtttttcacctgcccagtttcatggttagaagaaagtaagtaaacatttacaaatttagaaattgactagtggagctggaaacatagtgtagtagaggcacaccaccaatatatattgtataaatatataaaactttcaaagaatattattttttaaacaaagatcttttcctaaaaccataggttgactcttctttctgtaaacagaaggtgaatattggctgattgtagtgaatgctagttttagaacttgtatatttcctaagtaagaattttgaaaatggaaatctgtcctgtattagtttggaaagagttagtaccactgccatacaaacagcagatacctgataggagactagagtgatggctcactagtcaaaagcactagctgctttttcagaggaacagagttcagttcctagcatgatgtcaggtggctcacaaaactgcctgttcctccagcttaagagcattaaatgccacaggcacccacacacatatagcatgcatatgcatatatgcatatatatatatatataaatatatatatatatatatatatatacacacacatatacatatacacatattaaatctaaatacagtcaaaaccaatgcacaaaacacatttgaaaaagaacacatgtccttgctaaaatcccattacttaaaagaaatcttgtgaagccaaaaggctttcagacagactcatttgagaacatgaataaccactcccagtgatagagatatctcagtagttaagagcactgattcctcctcttccaaggaatccagatttgattctccacaccaacaaactggtgcagtcagctgtgacacctggaggagttacacactcatctggtctccatgggcaccgaccatgctacatgtggtgcacagagatatatcccagcaaaccacagataaacataaaaaggaggaggaagaggaagaagaaatggaggaggagaaatatttactcttaccacctctaatggatgaagtacaatatctaggcatagctatcagataagaaaaagataaaagatacaggaacatttggaataagatgcaagactacaaggtgctaatgtgataaagtgaatgaaaacttccagagtatcaaaggataaattcaaattctaagagagatgaagaatattggaaatcacaaaagagatactacaactgagaaacagagaaaaatactatgtagcaaaaaggaaaagcagcaagtggctccagccaagtggtggtgataagggatatctcatccataaggtaaaacagatgggactgactaaaacaatgcaatagtcttgatcacagaacaagcaagagtactcacaaagaattaattggaggtttcgtcatgacactgacttattctaagtcagcactggaaagggaaaaatccagtttataactgtattctggagaactagtcaggtgtcatgaaaagggatctacatttgtttgaaaacaaacaatcttgggggttgaaaaacatgaaacaattacaaataaggaaaaggggtgaagtcttgccatagtctatgggtgggaagaaagctgagtcaggtagatatggagtagagacttgattgactgagaaactcaagcaaagtagacaaggcttgaagggcactgtgtcaattaaccagcccttctgtggcaaggatcaaaccctacaatgtggaggataaagtgtcaagcctacaaaattggctctgtctgtcatgagggttgctgcctacagtacttgacaactctgaaggtaaggtccagtggagaaattgattccagctgtctgataccccttgcaatgtggtgacgacaggcaggatctaaaagtatagagaccagttctctagaacaaacagtgcttttttgacttccctcatttaaagcatacttgggagacaccctgtggcttgaaagtagccaactaagacagaaaagctggaaagtccctgaaggaaataatgaatgagtgaatgaatgaatacataaataaataggtgaaaatttaaaaaataaatgtaaaaatccctaggtcctgtacagcaaagttcagctagcaaagacactggtattcaaaaacactgacaatctcaaaccgaagatagttttctatgacatctgagctttgactggttccaaatcagcaccagcctcaataacaggactggaatattaggggatgcagaataaattactccaatacacttccttttacttgttattgttttagactttattttttgtaagactattatttacttactattctatttatttgtttgctttctattttgtttgctttctttacttattgaccatttgttccattcccattattcttagtattctacttcttttcatttaaacttgcttcccttttcttttcctgcccctttccccttttttttttccttaagctgctatttctaatttgaccctaaacaagttttgactacttacattattctaaacatatttttaattatcaatggtgctataaatgctggcatcaatcaattcaaagtctatatctgaaaattgtttggttttattgtatgtgttggaggtttctttcctcctttgagtagtgttaaggattgaaaactcaacagaaggctaattacaaataaaactggaaaacatatccatactgacaagtgtacaaattagaacacaaaaacaaacaaaacattataaatggaacaaagttatttcagaagatcagcatttaataaccaataaaaagatggccaactgtttgaaatgctgttcaaagaattctgaagtacatgtcaatgagaagtttagcaaagaaattgagactggtgctgggagggaggatgatggaaataaataaaataattaaaaatctcagtggaaaccataaataatagaccaaatcaagtacaagacagaacagcaggaattgaagaaaaatctgtattcagacacacaacaacacaataagtaaacacaaccaaaccttttagaacatgatcaaaatgaaactaaagaatacatggagcagaaggaacttaaaagcactgagactaagtcaatgaaataacagcagaaattttctaaaatatcgagaaagaaatgaacatctatacagaaagatgtgtaaaacccaaataaatcatggacagaaagaattgctcctgagcacagtgtagctcaaatcctaacactacaaagaaaataaaagtatcaacatactaacaaaggtaaattcactgtaacatccaacctctcactagaaatttttaaagacaaaaatcttttcaatgattactatatccaaagttatcttttaaatgtaatataaaaactttccaaggtaggcataacataaggccacttgtgaccactaaactacagtatacacttaaaggaaacttacacatagcagaatgatacaaacagaggagctcaaggaaaatgaattttgtaattctatatatgaaaaattaagaaagaagcaactgtgtctacataagttaatgaaagaaaaacagaacaatgaaagaaacaacaaaatataaatgtttttagcgttccatttatgagacagattagccaaatgaattaaaagcaggatcaaattatttgttgtctataagaaatgtatttcacttgaacagaagctaaaggaaaaaaaaaaggagactgaaaagtgagtggaaatcaaaaaagaactggactactgacataagtatatgactgtatactataaaagaaaacaactgggctggagagatagctcagcggttaaaagcacctactgctcttccaaaggtcccgagttcaaattccagcaaccacagggtggctcacaaccatctgtaatgagatctgacactctcttctggtgtgtctgatgacagctacagtgtacttacatataataataaataaatctctttaaaaatatattaaaaatgtaattgaggaaaatacctaaaaaaatattttaaaaaatatttaaaaaaagaaaacaaccaatgagggatgtacaattaattataagtatatatgcattaaatgatggtgtacccaagttcataaaaacaagcactaccagactactgtaaaatccaacctctcgggctggtgagatggctcagtgggtaagagcacccgactgctcttccgaaggtcccgagttcaaatcccagcaaccacatggtggctcacaaccatctgtaacaagatctgacgccctcttctggtctgtctgaagacagctgcagtgtacttacatataataaataaataaatcttaaaaaaaaatccaacctctcaccagaaagtacaatatccatatagaaagtaacaagtcaaaatacagtaaaatacagtaataatcttaactttccaaattaataacttatctgatggaaagaaggaaggaaggaaggaaggaaggaaggaaggaaggaagattgattttatctaaactgtaccaaacatcaaatggacttatttcaagacatctaaaaaacatctcaccttctgcagaataaaccttggcagcccatggaactctctaagagataaaccacatttttgaacattaggcaagtcaacaatagtaaaaattactttcttgtacttaacaaataataagagaataaaattaaaatgcaaaaaaaaaactaggtatgctacaaatacctgaagacaatataatacaatcttaagtatcataagagtaactgaaggaatcagaacagaagtgttttaaaggaataagtcaaatgaaaagaaaacacactaggaaacagcaaaatcatcctcagtgaagtaactcagactcagacagataaatatggtatgtattcacttataaaaaaaaaggatattagcagttaagtaaataataaccaaggtacaatctatagagccagagaggttaggtaaagaggggggatccagtagggatacaaggatctccctagaagagtgaaatagattatacagccaactgggagtagatagggagagtaagcaggtgtggggaggtgagcaggtggagggagagatggggttgagggaaagtgtggtagaaacagctggaattggggaggaaagaatttccatgttggtgtagaaacctagtgcattggaaatgtccttgaatgtatgaaagtgaccctaataaaatggtctagtaatggaagatatagaatcttaagtggccatctcttgtctccagacaaccaaagtgagttgcacttcagttaagtgaagagggtcccatagaaattcccaaacagggctggaaagatggctcagcagttaagaccactgactgctcttccagaggtcctaagctcaatccccagcaaccatatggtggctcacaaccatctgtaataggatccaatgccctcttctggtgtgtctgaagacagcaacagtgtacccacttatatgaaataaataaatcttagaagaaggaggaggaggaggaggaagagggagaaaagagaagaggaggaggaggaggaggaggaggaggaggaggaggaggaggaggaggaggaggaggagaagaagaagaagaagaagaagaagaagaagaagaagaagaagaagaagaagaagaagaagaagaagaagacgacaagaaagaaagaaagaaagaaagaaagaaagaaagaaagaaagaaagaaagaaagaaagaaagaaagaataatccccaaacagcctaagctgttgtcaaaacaacaggttgctacctgaaaactaacagtagagccctactgctaaggacaatatccacactacccaatgaacacggagaagccaagctgctgcctgcatggactcttcacccctacactctacttctttggtgtaggaaggtactctacaagctaccaaaagagatatacgcacaccaacccagccacaaaacctttgacctacaatctgtccttcctgtaaaatatgctaaggcagtaggggcaaagaactagtgggagtagccaaccaatgtctgatttgacttaaggcccactccatgagaagaagcctatatccagactgcttggataactaagaaccagaaacctagggtaaaacaaaaacactacttacgttttaaattttttttttaaatcttaaaaaattttaaagtcaataaaatgattatggtatacacattgtatcagtgcctaatctagttactgtcaaaagaggttttctctggcagcagatggaaacaggtgcagagatggagagaccacagtcagacattacatggacagaatatttaaatgggagctctcaatcaaatactttacagcagagagcagggaagcccttggaagagaaggtggaaaaactttaagagccagaggggatggacgataccagaacaagaccctctaaatcaactacgaaagtctcataggaaatgtcataaactgaagcagtgggtctgtaccaggtatgtatgtctgtatgtatgtctgtatgtatttgtaagtgtctgtgtgtattatatatgtatgtatgtatgcatgtatatgtatgcatatacatacatacatgtactacatgtattacatatattacgtgtattacatatatatgtagtatatttatactacaaatatgtatatacatataatacacacacacataggcacacacgcatgtgcacacaaacacacatgtaaaatagctataggtttagtattgtatggtactccctggtgtgagaacgaattaggcttctgactcttatgcctgctcttgtgactcttttcctcttgtttaccaaggcagactaccatgatagtttttgcttcatcttattgtattttattttgtcatgttaaaaaaaaaatcaagaaaggaaaatatattatgatacagaaaggcatctctaacagtgaagtttcactccttcctttagaaaattcggtcagaattcaaataaaaacttaacaatgcacatcacaatctcagaaaaataagaacaacccaaactacaaactaatacctggaaaaaaaaaagaataaagaccagtatagaaattaatgtactgaactctaaaacacagagttctttctttgaagagaataacaattccttagcccaaataaccaaagaaaggcaagaccaaattaataaaattcaaggttaagatgaggacaaaataaaatgtagtactgaaaacacatgaggtctttagtaattaatatgaaaagcaacatttaaaaagaatgaagtatctagaagaaagttataaattcctcaacaggtatgatctataaaaattatattaaaaggaaattaaaaaaaactaaagatacagaaagcaacaaaactgaagcagtacatcctaccaataaagaaaagcaaagaatagattcattgctaaaattaccagttctttatagaagaacaaacggcaaaaaacctcaaagtgttctaccaaacagggaatgaaaactactaaagccattctacaaaaatattattttgagagttccaaaccaggtaagagcacttagaaaagaacacacctcaaacatactaaaaggctataaaataacctgagactattgttatgttaaataaaaaaaaatactgaagtcatttttctctaatatcagacatgtgacaagggtgttcagtttctataatattattcaatgtagcactctgaagtcatagagaaaacaagaaaaaccagaacaaaacaaatgggaaagaaaagaacaaattatctctgtaagtacacaaaagcattctttacttaaggactctgataaacacttgtagcaaaaagaaagacataaccagggcttttctatataaccctacaaagatcccaagaaacccagagagacagagtgacagagacagacacacacagagagagagagagagagagagagagagagagagagagagagagagagagagagagagagaaatgaatatagcaaaaactgacaaatgagactgcaacagttaaaaggcaaatcagtagtgaagagacaaccaaaataatggaagaaaatctttaatgcagaaaactatacatctaacagaattagtatctagaatgtctaagaacaaaaaggcacgtgccaaataaactgatattccaatcctgcactaaattagccctcttcctcaacattgtaaaactcttctgtgataaaaatagaacaatccaacccaagggcatatgtactggagatctgctttagccccacatctgaggtgggacggcatggggtagggagagatgccttcttctacccccctctcactacctacagcaggtagaactggccctttcccttactgattgaatcactcaggagcacaggtcctgcaaattgactataacagctcagaaaagctggctatggtgatgttgcaggtaagctggatgcaaggacattgagagcacaagggctgatcctgcttcattgggtaagttaagcaggatagtgcttgagagttgacctcggctgagaaaaataactcaactacctcccaagcacagacccagggcctaccccaacatctactccaattatgatctgctggaacttatgaagttgccagttctgcacatccaaaactgcaggatctccatgacacagggtaacaacaggatatccaggagtcctggttgaggatccaatacggcagaacctagaggcctcaaaatagaccaataactcattgcaatgaacatttgcaagtagagatgtgtggacaaaagcctagaaaaacacaatacaaaaggccagtaaataaattcttcccaacatattatagttaaaaaataaataaataaaacacagactaaaggatactaaaggatacaagaaaaaagtgacatcactcataaagcaggctcatcaaaattaatatctattcaacaaaagtctttaaagcatgaagtgtctggatcagtgatccttaaccttcctagtgctgtgaccctttaatacagttcctcatgttgtgatgactcccaaccaaaagattatttcattggtacttcgtaactattgctactataatcaatcataatgtaaatatctgatatgcgggatatctgatacgcaacccctgtggcagttatgactctcaggctgaaaacagctagcctggatcctgaaagatcacaactggtaacacaaagcattacacttgtaaaactttacacaaaaattcaaagacaaatagaaattttccatgataaacagaaaaaacacacatctttcaagaactctgattgtaaatggtcttaattaatcccttctccaaagatacaaaataaagaaaattagaggaaaaatctaccaggtggatgttacaattttagacacataagcaacacagaggcgcacaatttcataggaggaatgctattagatctaaaaccacgtgtcagtctcaacagtgactgatagtgggtgacttcgctacccaactctctccagcagacagatcatctggacaaaaattaaaacagaaactctggagttaagtcaaatgaatgtaatagatatttgtacaacattccacccatatactaatacattcttctcagtctatggaattttctacaaaaatcaactacctatcaagacactgaaaaagtcataatatatgaatactgtaataccatacttctttgtatagaatacaatggaataaaattagatattaacagcaaaagatattacagaaaccatgggaactaaataacacattactgaacaggtgatctctgtgagctcaaagccttcctggtctacagagctagttcaaggagagtcagggctacacagagacaattatctcctctagaaactaacacccacagtttattcatctctgagaaaagcatcataaatgatgcacaagaaaatatcttcaaacagcaaatccctgttaaaggaactcaaagacaatataaacaaatggctgaatgagaactgcagaaacatgtaggtgaatcaagtaacacaatcctgagaaccttaggacacagaggatatctcaacataataaaggaaaaacagaagaaattcctggcaaacatgttaaataacaaatgaaaaaaaaaaaaaaaccctcagagcatccttactaaaattaggaacaaaacaagcacattctgggcctgtgcttgttatttcaggttaatataatgcttgaagtgctgatgagagaaatactgtaagtgaaggaactaaagaaatcaccagtcaggaaagaagtcaaattatctttatttacaataaaatggttctattaaaaaaaaatcctgtaagtagcaaactgtaagaatctaccagaaaactcctacagttgataaacactcagcaaagtaacaatacaaaatgaagacacaaaactcagtagtctttctttgtacaaataataaacaaaaagacaaagaaattagggaaaccatcccagtcacaataacctcaaaaattatttgaataaatcaaactaaggaagtacaagagttgtataattaaattttaaaaaattaaagaaaatatgttgaaaaagcaaccagaaggtgaaaaaaaaccacccatgctcagaatgttgtaaaaatagtcattctacctaaaacaatttacagactcaatataatccccatcaaaatcatagcttgatttttcataaaaagaaacactaaaatttatttcataatacacatgacagaaaaacaatcctgaatagtaaaagaagtgctatcagtatcatcatctatgattttaagttatactacaaagctttagtaataaaaacagcatggtgctgacataaaaacagacacttcaagtaatgaaatcgaagtgaaaacttcttgatggtaagatcagattgctatagacaccaaccacatccttgaatcacagagcatggagacattatgctggtactcactggaaaactttatcacaactggctataatccactgtgctggcaagtgctatataaactctcttgagaataaaggcctcaatctcatccagttatgaaccctgaaggctaaaagtggcctgacaagataggattactaataattgcataggtgttttaggagtaactagccactatatgattgcattaaaggtctactctataaagtggaggccatactattaaaggagccaagaacttgtgaatagataaggtaataggccctagggtagaacccataccattactctgctaaatgcacataatattaaaatgactcctaatgattattgctatatcccgagaaaagcccattattttagctttcactagagaagctttgctccgtaacatatggcaagtaacagagatgatcctattccaaaactggtaagcatggcaagaaaaagaaagtgttaagtgctcaatcccaaatcagacatttatctcaccccaaagagctggaaagatggtcactcacaggtggtaaataacttcaaggaaacagtcttttccaagagcaagagactagatgcatatatgaacttatgacaagtcattacgataatacacccaagctacagccagccaaaaccccagcatgggggggtgggggtagagatgtcatcctaccacaagtgtcttatgaacccctggtaatctgactacacactacagcaggtcccaattccaagactagcctgacaatgcaaaactagactcaatggagaataaaggaaaaaaagtttgaaaaagtataatcttaaaataatggaagggttgagagggctgtaagaggaggagttgaggaagtgattatattcatttagagactagatgaaattttcaaatttttttaaaggaaaaaagaattttgtaaaaaaaaaaaaaaattaaacttcaacctcttgaattgttgaccagtgacatcccagtgatcactctcttccaatgctggctatttatttccatagtttttggttactctccagaacttgacagtaagacactactactgaagatataacacacttcagtaaagaaatggaaaaattaagcaaaaactcaccttgaagcttgatctctactaactaggatctgtacaacttgacaatgctatgcaaactatctgacgagaaaagtaatcaggagatattcaacttataaccaaccaatggtccttagttatatcacagttcattcccaaagtttccatatcatttctgtggtccaatagcaatcactgactccactattccacactaactatatatagtgaaagcatgacccaataactaatccttgtatcttccaaaataccaaattacagactcaataatctctaatttctcttttgttattgcttactttttttagttggtattcctctagttatttgactttgatgaaaaacttctcagatttcttctccatattagaaggctaatcttaggttaaagaaccttcaaaggttcaatctgaccaagagtatgctcaaaaaacccagaaaaatttttgaaaatagaaccacctataattagagttcagtttcacacagaaacttaaaagcatccgatcttataaccagaagtcaccctgataaaaatgttcagctctcataaaaaattctgaaaaaacattcaaggatcaacaaggcaaagtgatttgtcaaatggcatattcttaagatgttatgtattatccctcataatcacaggctgagaatatgtaatagttatttagaaataaactgctaccacaatatatttctgagacactaaatatttttcatacatttaatgatttttcactaacacttagtaagcaagcattaactcattaactaactattccttatatattttgctacgtattcaaggtagctttagttgtgaatttgatagtctaatgtgtagtgtgacctaagggactctcaattgagggactacctagattaaactggcccatgggtgtgactgggggaaaggggaaggtcttgattgatgtaagagggaccagtgtactgtggataatagcattccctaggcaggtggttttggactgtaagtaagtggtgttagcaatgcttaggtctgaaaattgagtcagcaacagtataaagttcctgccctgactactttgaacgatggcctataacatgtaagctgaaataaaccctttactcccctaagtttctttttgttagactgttaaatataaacagaacattaggttcccattctactgagaccttaaaagaaatgaagtgatactaaatctcagaaaggaaaatagtaagaattgagaagatgggacacaatcatattttgatagagatactcagaaaagatacctatgacaggcattatctaagaattctgaaacaagtaaaaaagaaaaacacgtagattaactcaagagggaacagtcagtaagttccagaactaaaacctcaaaagttgcaggttaagaacataatgctagtacaggatgtcacataaatgaaagagccagttcagggctgtatcaatttctaaccatagtttaagaaataggaaacctttgaaaagttgagtatagaaaagatggcttaacttttttttaatcagaaaagcccattgaattgttggtagtaaatagaggtaggaacaaaagtactgagaaacaatgatgtcccttatcaaaagatggcaatggtactacaaatgctttttaaagaagctgaaatgtattctgaagataaatgcaacataacttgcaaacagttccaatatgtgacacaaagagaaactaaggatgctttctagaatttggtttaaaataaagtcctactaaataagatgcaaatgtctatcagatttcaagggattgatagcatacaaataacagttctattttggatgaattgatttctggcttttttggggggtggtgtatacatgtgttgtgcacacaaacatggaggcatgcatgcccatgcatgtgcatttggagaccagaaagcaaaggcggtcataattttctaatgctcctcacacaattttttaagacgtggtctctccctaaacctgacacttgctgaattatctagactgaatgaacacatttcaaccaccattccatttctgcccctccaccaaggctgggatgaaaggccttgcctcactttttacataggttctgaaattctagtccacatagttggaaagcaggacactgagccaactctttaggccctgcttttagctgctttttgtgtttgtttgtttgtttgtttgtttgtttaaagccatgatctcatgtaactttgacttgccttactgtataggcgaagctgtccctgaataagctcccaagtaccgggagtacagaagtggagcaagcaaacatacccagccaaatatcaaaattcttaatacttctatatgcacaaattcataatatgaaattttcatataatccacctagatatcttctggttttctttcttcttctattaaactcatgggctaaaggacatcaatgtcaatgtgcatgttatatcccagtattaagagtctccaaaattatttgtatttcttaataagagaactttacaatctctttatttccaaccataactcctttatcttaagcataataaacaccatatgtaggattattaaaatgttattcgtctgttaaaaacactcactcatgcaataataattttaatatatgaagacacggctgtttttccaaagtttttattttcattgacaaataagaactacatatattatcatatgcaaaagtgatacatcaaatgagtttataaattctaacatagcacttttgcacatatacttaatagttgacttttagtgatattcaagaaaatatacagaaagaagtcaccatgctctacaattttggtcctgaactacattctattcattttgcattttttatgtctatcatttattctactctaagtaacaaacaatttttagaatgtttttacagtctatgtacaggaagatgatgcactacctgtttttgtgctgatttatttcattgaaaatataaaggatcatttccatccatgttgtcaccgacataagatttcagaaaaaaattttaatggcgaaaaattacatcatcatatatgtcaatttttatttgtttagccactgacaaacactggtttatttctgcattttgtttaattaatgctgcaatcaaaattaaactgcaggtatctcttataacacactatatatttctataatacaattgctaggtcattgcaatttttaggaacctgttattttccataatcgatctaatttacattccaaacaactgtgtacaagatttctgtttgcttacaacctcaccaacatgaacattcatatattctagcaggtaggaagtagtatctcactgttgtttcatttcttagatgattagaaaggtaaagaattttttttctcatgaatttgatgctggtcatggtggtacaacacctttaatctcacactcagaaagcagaaacaggagaatatctgagtttgaagtcagccttgtctacagagcaagttccaggacactcaggctacacagagaaaaacttgtctcaaaaaacaaaaataaataaataggtttttcctcaacacagaaaaagagcaagaattgaaatatttgagattctgcaaagaatagaggaaaagaaaaaatattataatatcaaaataatttttaaaaactcatttaaccactttgccatttgtactccttttttcccctgtctggtctataccaccttacttgtcatcctctggactgtagtccagttccacattctttcaccagcatagagcttaccaatcagattagccccatggatcctcctggatcttcctccccagcaccggaattttatgtgtacactaccacacactgcatttttatgttgttatgaaagttatcaaatcaggtccttatgcttcttaggcaagcattttacctactgagctatcttcctaccggaactacttgttcagaagcacctatttaggtcccctatccacttcttccatgagctgtctgaattacacatttcataaagtaactattcagcatgtgaatgctttcattcattccataggggggttatctgttaactatatcttttcttgtgtagaaagctattgttttgtataaccccattagtctattttttgtagttatgtttttaaaacaaaatttacaaacactaattaaaaagcttttcctgttttaatatattaggtgatacttaaaagaggatattaactaaggacacaactttgtcctatttaacatactggtttttttattctgcaagagtggtcagtgctcctaatagctgagccaccttgcagcctcaagaatgcttgagtcagagagtaaggcaatatggcccctgtagttaggcagacttgggttttgattttagctgatgttgtttcttttggggatttcaagacagtgtttcttgatgtagctttgggtgtcctagaacttcctcctgactgtctctgcctcccaagggattaaagattaaaggcatgcaacaccaccatactgggctaaaataaattccacttaattataatgaataataattatgtattgtttaattcagttggttattcctttctgaagaacttttgttactagcctatagtactagacttttgttttcatatgagagtaatgacttaacttatagtattagttcttcaaggtttagtgaatttcatcagtgatatcattaggttctgggctttatgtgacaaaagacttaattcctgatttttccatcttctgatgacacaacattctcaactctggccatcaataatagcatgcaaacttaaaatgctctaatgctaaaagtgttatacatgaaacactactaatggtttgtcctatctattctgctaatattcaatctaaaatattatctattagagactactggtacagtctaactgcaagcactatgaggtttctaaactaagcaggccattcagtgcatgaaactttcaacatttggtctgtttttttaaaacccttcatatcttggtaagttttcagtacactcaatctcaactcaattataactatagtgttccacaaaacatcattaaacctttttcaaaagaaaaagaaaaagaaaaagaaaaaggaaaagaaaaagaaaaaaaaagtacatggggagcaaagatgtggtggcacacactttaatctcagcgcttaggaggcaggggcaggccagtctctgagtttgaggccaaattggtctacagagccagtttcaggacagccagggttaaacagagaaaccctatctcgatggggagggggaaaaaaggtacatggggaaggcagttctttagtttctactatacctgcagctatctaggtatacaaaataaacgagttttcttttaaacaacaacaacaacaacaaaagttatttggctactaaactacaataaaatataacctcacatccattaggatgactattgttccccaaagaaattttaatatacgggtcaagttgtaaaaaaaaaatgtataaaacttttattctaagaaatgtaagtaaaatggtatagctattgtttaaaacagcatgatatattctcaaaatattaaaaatacaattaccatgatattctataggaccaaaagaatttgacaaaagattagacccatgctaatcacaacattattcacaattgctaaagcacagaattaacccattaacaaatgagcagaatatagcatatacaagcaagcaagtgttattcagccaaaaaaaaaaaaaaaaaaggaggaagttctagtatatgctacacataaacttcaagaacactgtgttatataaaataagccagtcatcaaaacaaaacaaaaactgtgtgactacacttacttgagatagttagaagcaccaaacccacagacaaaaagtagaatttaattgccagccacagtggaagaaacaggtcactatttaatgcatacaaagtttcagtagggcaaaatgcaaacagttctgatgacaaatgctcaaacatattaatatttacaataccactggctcatatactttagaacaataaagagtaaattttatacattttataagtgttttaaagttatcagagaagttacatggtctcaaaaatttaaaggataattcatagttgtttcttaagacttcacaatgtacttaagcatttaaagggatgtaatctgcttctagtaaggaaaacctggactttttcaaccacaccttaaacatagctatacacatctatctttacttcctcctcatttcttaagacaggaatgcatatgtgtgtgcattaacatagatggtataggtagatttatacatgtagagaggtgtgtttagaagtcagaggcttgttttcactatactcaaagcttgtcaattatgctaacctagcagccagcttgcctcttactccagtcttcttaatacttacatagcaagtgctatattcaccaagtctttgccacagtcccctgcttaattccttctagttattcctattttcatttttcattcctcattgtcaaattttgaaaaggttctcaatttcctacttttccctacactcaagtgtcttgcttcagaaccttggcaatgacttggcctagaacactgttcaaatatccaactgcttaatccccagtaacatttcaggattcaacctagttttactcagctataccaatgttcctactatgcactagatttcttttgcataatttggtactcctctgtattcccactgtataccaagtataattctatctcaataattaaaaaatctgattctgctctttctgaagcattgagatataagtctcaagcatctttatacccaaaacatagcacctgatgattaatatttagaacaggggtcatatttaaacaatcttgctttcaggaattataaattaatagcaggcacatagatgtttgaatcttcctctaattcccctatttatcaacaactgccaagggcacaaaaaacattgaaaattcagaatcatgtatgtaattatctacttaccattagacatctaattttttgcagaggtttggaagtatttggttaggagatataagtagacatgttccaatctctagatacaatttaaagttgttccttctttttctttttttaattcaattttacctttttttattttaagcctgaaaggtattttcaaataaaatagtgtagggcaacttgagacacaaaataacctgaacgaagttatacttacattcggctagcttcaatgtcctcagactgggattctcctggtgatctgtaaaatgtaattaaagacaaatattagtgatttccaaaaaaaaggtatagaaatataagtaaggaagataaactggaaaacaagacttaaattccaatgaaagggtgctttaaaagatttaaaactaagaaaaaaaaagtagaaagatcagattatcacaacacatttaagaacaaattttagaaacctcaatgtttaaaaagaaaattaaaatctttatatttagatatcaaattagtataagccataattatttacaatgtcaaacacatattaaaaaacaagactgttactttctattaagttgggttgtggtattcatagtcttgaaattaaatgaagtgtttgcaaactgtaacctgagcaaacactaaggtgtaggataatcacctttattttgaagtgatattatactgagagatttgtattcatttatacactgtctatgtattcagaaaaagcaaggataagtacttgcagaaaaaactatttccttcaaaacctaaaacattataaaaaaaaaaaatcccttgaaaaatgtctgccaatttctgcagtagacaatttaaactcaaatataacagtgttcatagatctttaagatatttaaatgctatgcaccattctaatcataattcctgtggttctataaggaaattagatttccctaaaaagcactatctgccgtcaccgtgtatatggagcattatgtttgctagataattgtaggctagttttagttttaatatctgctggttattttctttattttttaatatattagctaatatagaaatacatataaagcaccaaagagtatcccatttttattgggtggaacataagccaatttccctattctgaacatctggttaaagaacaaattccagtgatgcacacagcaatactttgctatacttcctgtcatcagaatgctaaaccaggatttagcatgaggacaggctgttctacatagtgagacactgcctcccaaaaagaaaaaaatctgttaccctacatatctttactgtgagacaatcaatgttctaaggtaaatttattttaatacctatttctaatgctttaaattcccaaaataggttaagaaagaaaagaataatttaaattttcaaatttgtatacaaagacaatctgtgaatttactactgactttagtctttcaagttaaagacttgatttgtaaatttatcactgacttcagatattcaacttaaacaaaaagtttataaaaggctggttgtggcttatggttatggaagattttttaaagcaatgattcttaagttaggggataaagaagaggctcactagttaagagcacttactgctcccagagaaatcaaggtttgcctcttagcacccacacagctgctcacaaccatcacaaactccagttccagcactgatgccctcttctggcctatgtgagtatcaggtgcacatgtgcatctggtacacacatacatacctgcaagtaaaactcacacacagaaaatttaaaaatcttagccaggcaatggtggcgcacgcctttaatcctagaagttggagggcagaggcattggatttctgagtttgaagccagtctggtctacagagtgagttccaggactacacagagagaaatccctgtcttaaaaaaacaaaaaacaacaacaaaaaatcttaaaaattaatgtattcacttctttagtgtcaaagaaatttcacttctttgcttgactttcaaaataatactcattgtaattcatttagattccaagtcagtaacacacacacaaagaaaaaggaaaaaagatacgattaaaaacagaccccaaaagctcagacagtttagattttcttagtagtttatttatatttttctgtttatcacaaaattacataagaattgaaaaatgtagattaggagtgatatcaaataaaaaattctccaccctcttcccccagaaaacaagcaaatatctcagaaataatgatctctacagccttaagaaactaccaagattgtttccaaacttatatctcatataaaatggctagaagagttaaaacatgatggtaacccatgcactagctaactcattttggaatgtgtctttccaacatctcatatattattaagactgtgagataaagctgacttgcaaaacaacaacaaaaacctgttagcaattaggaagccaaattagaagtctctaaacaggtaggaagcaaagtgttctaaatgtacaggaaaagaaaaatttagagaaggttaagaatgatgagagaaaaaatattatataagaaaatataagataagagaaaaaaagaactatatctcaagagaatattatagaactgctgcagtttcaagaccctaaaatgaactatagaacaaacatattgtcaaatggccaactacagctattttcgcaatttctgattgctacagagtatgtgaatgccagtaacataatgccaaccaagtattgtaaatatactagacttctatttaatattcacaaatattagagtaagttattaagcaccatttagccaaactaaaatttaagaaaccccagaaagatcagagtaaaattaatccaaacaaattattcttcttaaattatactcttcttgatctcttagacatagtatagcagaggctgctcccattcaaacagttttactttagtcaagagaaaaatatataaatacaacaaaagcatgtttctgatcattgtgtacatctgaatgtctatgcagacaattttaataatattctaattaagttgccaaaatatatcctaaaactagagttaactttcaaagtaactctatttttataactattagtaggtgttacaaaccacaaagtatatgtaacacctactaatagttataaaactgttctctgctcttaaaatgcttgctgctttttactgacaatacatttgaaataagaattcaggacatgctcctaattttaccaaattcaaaatatagaaccaactaaaagttaataaaaaatccactaccaacccaagactgacccaagttatcctaaagtttaccagaatattaataaaggaatgaatgaaatttgaaacctgaaaaatacctagtaacaatggtgaggaaaaagtcttttaaaagtatcaattttaggtattaactttaaagacagaaaatgtaatcacaaaacaaataatctgaacactggaacatgacctagtaaatccatccttttaaggaggtaaaggtgcacttttaactccactgtaactctctaggagaaaaagtacactcattttactaaaggtgcaacatttctggagaagcactgaaactcctgccacataaaatattaaaaataatacttaagatattttccacatatctcttaaaatgtccacactgtaatcttcaaaatacttaagacatattttcttattaatctatgcagaaaaacaggtctttgatgattacttatcttcatgaactgaagggtaagtaagaaatgcactataataaatatctgagaaaggaggttaaatgaagaaatggctccgttcttaggtcttttattcttagcaatattcctgctacctatgcatttttgtcatttttatagcacataattcatcttacaatgacagcctttctaagactgtaaaataacattcaaaattaccttttacaagctgtggccattcggtgacatcagggtgataacagctttgagtcactgattaaaaacaggttgtcacaccagtctagctgctaacttgatctgaacgtaggcttaataattctaataaattaaacaaacctttagttagaacactagcataaacccaattcattgttcaagtcattatcttcaaagctttaaatcagtagtcaatataaaattagaagaataattatcacaggaaaacctttatgaactattcttcagtatattgttttcttaaatggtctcttcatttgagaaaatgaggtatattctcaatccaaaactactccaaaatccagaatgttttaaatcatcatggcagcaaataaaaaagggctggatttaggaatatttccgattttgaattttcagactaggtatgttcaaacagtaaagtctataggaacatgccaaaatctgaaaaattcttaaatttgaaacatagtctggtcccaggcatttctgataaagataataatccctacttttcaatgtagtactatatggctcacaaaatacaacaatcaactgtacccttacattccactgactttagctctacaagatcaaaatagaagaataacaataagcagcctcagagtgattaactgacttgccgaagattttgtaaataatgttgaaattaagaccaaaaaaccaatatcagctaaatttccactaagtattagaattttgctatggtttagttttgctttacagtgttttgtaatttaaatacatacaaaaagcaaaaatttagactatgtattgtggcagtaattagaatgaaactgatttagtatcaagagtctttaactgatgggagaaatcagctaccaaacaggcaaaatcttgattaaagttttacacacacacacacacacacacacacacacacacacacgcacccacacatgaaagagagagagagagagagagacagagacagagagacagaaattatttaagtagtataatctatcattaacttttagacctttggatctataagaaagcattcgttttcaatcccactaagactcaattctaggaagtaatataaagcaaaatatgaatgaatatcctattattcacatatctgaactatcatatgtgattttaaacaaatctgattcgtttcacagccctccttatcatactatactcctgacaaaatgccaatactgttatggttttatccagttttcccccaaaatcctctttcactgatctataaacatagaacaaatttgaatgagcttaaaacaaaacaaaacaaaacaagaaagaaagaaagaaagaaagaaagaaagaaagaaagaaagaagaaaagggagtgtaagattaggaagaggaagccccttcacaattaacaccctcaaattgacagcacagacaagccagatggctgaaagcacggaatcagaacccaacttaaaacaggaagtagtgagaatcccaaaggaattattaaagcatcaatatttgaacccatattattgttagagttggctcaagtttatattatatatatatatatatatatatatatatatatatatatatatatatatataaacaaaatcagggggtcccaataaataggatttataacccctgttaagaaataacccaatttcccaaatttccctatcataactatttatcttctactaagaacagaggcatcactgaactagcaagggagagaaataacatccttgaaataaatgtggtccatggcatagttcccttagtttctcatcaaacagcttatgtggaattatgtgaatactgaaatgaatctaacttctaacttacaaacacaaagataacacagcttaaataaaatcaactaattcattaaagaactatatatactcttaggattactaaatcaagtactctccactagtctcctctttattaggttcaatgttcagttgaacagtttccaaagacattctaagattccactctccatgatcacttactatagggaaatcttggacaagttacataacctctctaaacctcaattatcttaaagcagaattaaaaccctagtctgggttatcataagagtgccttatataaaatatgtttgcaaataaatgaaagagatttttcatacccacagcctaacagccaagtctatttccttgaccttcttgttcatattactttgtctcataatacagtaaactcacaaattcttccaacaccccacttatatccctcacagtctacctggttgtatactcagcacctagtaagagtctttaaaattgacaggcgcccaaatttattgaacgcatttgtcattatactagccgtaatattaaaataattcatgcaatatgaatttcaaaaaataaaacagaaacataccatatttcgccaaacttctgaggagctggtgaactctaaaatcaggctcttagagagattttttaacctaaaatataaaacacctcactcaattcttttaacataaactggatagtctttcagaaaaaaaattactcaaattcattataaaataaaagccaatttctcttcaataatacttataaagatccaaaaatatattgaaagacaaattaccccactcctattgccaagaaaagtagcagggtagctctgtaggctgtgagctgaatattttccgactaggaaagccatgtttcccatcttcatgtacaaaaagtaatgctccacaatccctttcctcaaaccccttcagatatctacagtaagtccacttccaggtaatctctatatgaaaaacttctgctatataaaacctagagtagcaaccatggctaaatcctctgacctgtcagtctctcaagagtgctaagttgttgaattagagaaaatgtataaaaagaatatagatgctttcctgacacataacagggctctgttactcaactaagtcactccatgtctatcacaattctttacaaataaacaataacaatgtacttattacagagcttaaaacaagctctcctatgattttaaatttgtgttcatagttcatttataacttgtcttgaatatttttcagcctttaatatcttttaatcttattttgtcataaggagaaaacctaatcctatggattaagcaactacaaaataaataaatctgcatattatttataggtaaataggttggcaggtaggtgagtgagaaggaaagaaggaaaggcaaatggatgggctgataaatgatggatgggtgggtggatggacagacagattaataaattgatagatggactgatataacactatggtctccccaaagataaactttatcacatactagtaaatcctgtggcataacagtaggattctcgttccaatgactcaaatcagaaaagttcaaatcatcctgccaaatataatatattgctcactcactgctaccaattccacctcagggatctccccacaatccaacactatccctaataattctccagtggcctttacttgctttcggtatagcttaattgctccatcacaatatgtaaaactatgtttccaaaccctgctagtatacccttccttccagactagacaaaacattgagagtatgtccttaatttttatactaaatgttttaaaaggtttatagaataaaacagcacagaaaaaaaaaaaaaaagaaacttgggtagctatgtaaatgcaaggctaagaaacttcaatctgtttcaaaagactatccatgtccatttccttataaaccagtctaactcaaagtcacgccggaaaaattagctttaaaattcttttttgtaatatttcatctttaaagaaagaatccattgcttcttttccccacatggttactaagattgttgtgatacagagtcttgtcattttacctcatttctctcttacatatttgacagaactatcctcctagaaattagaatttggtcatatccctctcatattaaaaaaaaatccctatgccttctcaattctgttaacataaatttcaaacttttttttacatattaactgatgtccttgtcatatggtcacatccagtaatccaaacattacccatatatgatgacatcctgaaatatcaatctcccttggttattgtactctatcatatatcagaaatctctatttctggtcctaataattttgcttctcaggatattccacaagaaatgttttcctgtgctctgcaatttccatcctctctttatctataaaagcctatttaaaaaacaaacaaaactattcttcttaaaactttagagcaccccaaatgaacaatgacagttaaggactgagaatgacaataacactaacaatgaaaaaaatcagaaccttcacatattactaataaaagtatttcaaaggaatataaatatatagccactttgagaaaagttttaaaatgcctctagttttaaatagttgccatatttcccagacaactcacacctagatatataatcaagagaatgctatatatttacaacaaaagttaaatccatatatatgtatgtattatatattatatatctattatataatatataattatttatgtgtgtgtgtatacacacacacacacaaaataccataacaacccaaaatgaaagcatacagaagcccatatactgatgactggacagataatcagctatttaaaaaacaaacaaacaaacaaacaaacaaaaaaccaaaaaaaaaaaagaaacaaaaaaaaaaaccttgtagagtttcttttcttttaaatttttttctgtaaattataaaacacacagaaaattgcttagcatacagcaggccctggatttcaaactccagcacttaaaaaaaattaattaaaatcattaaattgaagcatgtagaaaaaaatcataaaactcttatcattttaccaaccactcagaattaaagcaaacacaaaagatgccatttgatatcattatttaaaatctaactattccaagtactggttagagatgctagaaacaaaaatgttcattcactggtgatacagtatatgttggcaaatcaaatttacataaaatttgccgtatctaatcaagttaaggatatatcctattttctaacaacttcatccctttaattttccctaaagaaaaccttttacaaaggaagtataaaaatgatctgcgcaatataggaagcaattcaaaatattcataagcagtgggatacaatactatttagttatccatatactataataccataaaagatatgtgtcaacatacacatctcaaaaacagataaaacacataaaataaaacacataaaataaagacacataaactgatggcaagtatgtatgaaacacatctataaattcttaagcatgatatctcacttattggcaaaggtcatatttaagtacaaaacagaagatattcaagaacttcaagaaatctcttacatggataagaagagagggtattaggacttggaggaagagattaagtttccaaaacaaaaatcaaaactggcatttatattccaggatggtaggtaagtagattattgatatactattaagtgctttaaatattttataacatgttttaataagaaacaatctgaatatacaatttctaagctaaaaacaaaaccctaagactatggagacttccatgacacaatcttcccaatttattaaaagtatgctaataagataaaaatgtatggctcttgagattatctccatgagtaggataaagccatataagcctgacactttaaaaaaaaaaaaaaaacactctgggattaaagttaaaaattgagagaccttaatctacctaactatcctctgacctccacccgcatcacagcatggcactcttatgtccaaatacacattatacaacacataatgataataatagtaataataattcaaaagattaagacaaaatataaaggactaaaggactagaagaaatgttccctgggtttaatgccaagaaccccccccaaaaaaaactattattataacatgataattttaagcgcagaataggtgtctaaataattaagctattatctcttgaccactaaaaagacgaattagtatcaatttttaaaagaccttcagaaggtctttgttaattgtccaggccactatagtactgcttaattctgtttacctttaaattctcaagcctagagaattatgtattaccatacatacatatttcaagagcctacagcagatatcctaacccagacctgaacaatctagaaagtagttcattcaatccaacatttacaaatacctgcatctgcagaagggaaaggaaaaggacaaaagggagagaacagtgagagaggaaagaactgggagacatgaggttagaaagagagaaaaaagagaagaggaaagatggaaaaagggagaagacaaaggatacagaatacaaaatgtgtacacaaacatttactgttctcccagactcttcagtataggaatagacatctaatttcaactggttaagttatgtgcatatatctgtttttacgttcacctcttccctgtgtttcatttaactcaaaaaaaaaaaaaaaatggagtaagagaaaatttcagaatcagtagaaagatgatccatacaaagttaaatcagaccaaaacaatctttcatttttaaagtgacatgaaacataatgtaccagccagtaattatacatgatgttaagtacagataaaagactaaaattagctcagttctcctactatgctttaagagctcttactttaaaattatatagcccaatctgtagaggaaagtatattcctcctttaagttcctaaacttgtacataacttcttattcccatctccagtctagaatcctgtacaatgttatagaatcagtgagaaacagtaacagagaggatggagaatgggacagaatttccaagcggagaaatttcatttctttgaaactaaggatttggattttcttaatgtattttctatcagtaacacatgatacagagtcaggtcacttcaaaagtgaggacaaaaacatattctctaatgagtctttatctgaaataagatttatctattattatacatactatacaacaggtactcaaaaaacaacattttaagttaccaaacaaaaacacatttagcaaaggcaaatattatctttatttttagcatattgtacgcttagcaaatatatctacacaaaggggcatagtaaatagaaatcttaagggagaaatactaataaattgaggctactctacttccccttaggatgcactaggcattatttttcttaaaaaagaaaaagaaaaagaaaaagaaaaagaaaagaaaaaaaaagaaagagggactatgcatttcatcttttcctttccaaaaaaatagcagtatgattcacatctgatactaggtaaagtgctgaaacctataatgagaagagtggtatcaactaatgaaaacaaggaatgagtttcagaaaagacaagaattcaaggaaataacaaaatataaagtttgttcaaactaaatggtacattacatggttggtttcttttaatttcttctatattgttcatatcttctatatttaactagaggtatcagcatttattttatatcacagattataaaactaaattaattatggccatggttccacaatggtatctctaagactactttttcatatcagaaagtccattagaagttttaagtgaatagccatctcttttattcaaaaaagcaaaaaaacaaacaaataaaaaaaacataggtttttgttttaaaaaaagaaaaattttatcacattaaaacactgttctgtcgggcagtggtggcccacgcctttaatccctgcacttgggaagcagaggcaggcggatttctgagtttgaggtctccctggtctacagagtgagttccaggacagccagggctatacagagaaaccctgtctcaaaaacaacaacaacaacaaaaacaaaaacaaaaaaaacaaaaaaccaccgttcagaaaagtacaacactgacagtatcttcattcatgtcatagctatgtaatttgtgtgccaaactgcttgctttaaatgtccagaagaacattctgaattgaagatatatgcattggacaccacacacacacaaaaaaaattggttcacacccatagtccccagcactggagcagtgtaatcagaaggataagtaggtgaggttatcttcaactactaagaaattgagaccagtgtggactacaagatattctgtcttttaaaaaaacatataaaacaaacaagaactaaaaagtgtctcagcacttgggccgaagaccaagaattcaagggcagtctgcactacatgtccagatacagtctatcctaggttacataccatgatttttatcaactactactactccgccgccacctccgccgccaccaccaccactgccgccacagctaccaccatccatccacgcacacacccacacacataccccatcaccattcaaactagatttctaaggctccataacatatttttttcaaagtatttttttcaacctagtgatgtagctcactgctaggtagcaaggccctgtattctatccccagctatgtaaaactaaaattgaaggattttttttaatatctgatttctgtcaaattaatgagagttgtgctatactgcttaaatgatgttgacaggtaagaaagaccaaattctgaaatgtactgagctgctgctaagagtaacaacagattacacacaaggttatgtgtaaggaaaattttatcctgctcatataaaaagttcagtacctatatactactactactactactctggtttcactcaaataaggatgccagcttcagcaagatttacataggattctccttcataagcctaatgcaatttcttcgtgaggcttctcctcagatttgctacaactgaactgcaagaataagcttaactatggtactatggcccctaaaggctaccctttcccatcattcttataactgattcacttgcaattcatttaattaaaaatcaggtcaagaagagcaaatgacaaggaattcagctttgcaaataacttatcactaacaatttcatgttaaatgtacattacttatttctaggttttacctgaagccacagaagtaataagtgcttcagaacttcagtggtttaggaaacaaaacaacctaagcttattgaaatagttatcaaatctgaaactaattcatatattgtaattgcggctgtaaaggagatatacccctgcaatcccagctctcaaaagaggtacataccagaaagaccaggaggcttagccatgttaacagaaaacaatataaccgtattccatcatcctttctcctacaaatttcctgggcaagttactttctttatacagtatctatcaatgttcaagaagtatcacatatgagcagcataatcctctgtaacaagaaggcagtaccactttaatatgattaacaaggccttagaaagataaatggcctgctcctatttagctcactctggctcaagacagatgtcaggaaagcagcaacttctgacaacatgaatattgcattctttattccatttcaataatcctaagttgttttgtttcctaaaccactgaaattctgagccatttacttattctgtggcttcaggtaaaacctaaaagtaataagtaatgtatattgaaacctctttcaaaaatcagtataaaaaatttttttcatgtatagataggcccaatacttataatctttccaaattactattcattagtttagttgttatagacaactgaaatcaagaaagtataggtaatattttgaaattaaatgaaaacaaaggaaatctgatgtgtacattaataagtcactttattaagaaggaataagtgtcatgtatttcaagcctttcatggttggaaaaagaaattgagaaaaataataatatttctacttaatacaatttatttcacatcttttatttaaaagaattaaatcctgtgctatcttataaggattatattttactaatagtataaaaatatataactccataaaagtgaattgctaattgcaaaataagtgtagctattcttccaaacaaacatctctgactcttattattgaatcagaatggtaatcattgtccaaataaatgagtcctaacaggctgagtagcatactagactaaatctatttcattttatatataccacatgtgcatgtgtactgtaaaaggatattgatgggctgcaagtaagacatgaacacatataccaaggatacaaaaaaggatacaaacagtatcctttacaattgtagctaaggggttaagggatattaagtctacagaactgccctaaaactggaggggcacagacaattaaattccataacttaacagaattatcacattaaaaaataaaatggtgttatgtgcaataaataaccaacctatcagtttccaaatgatagatattttctttttttttaacccttataacccatgtcagctcacacaattcaaaggagcctcagaaacactacctgatactgataactatttcagacatattcttctatgtgatctgaatctttgcacccccccaaaaaaaaacttcactaaaagcctaaaatcggaggtgatgaaattacaagtgtaatttttaggaggacctacattgatgaatgagagcaatgtcctaattttaaaagaccatttagtcttagctgaagcaggtggatctttgagttagaggccagcttcgactatttacctagcttcagaggctagtgagagacactgacacaagaaagggaagcggggaggggaaaaagacaaaagaaaaaagaaaggaaggggagggaaatatagggaaggctggagagatgattcaaaagttaaattaaaagcacttgttgctcttccagaggacctgggttcaatttctagagcccacatggcaattaacaactgtctatatcccagtcacagcagttccaacactctcttctcacccctacagacaccacaccaatgtggactctcatataataaaatcaaaaaaagaacaaacaaaaacaaacaaacaaaaaccctaataaacagagacagagatacagagacatagtgatactggcctgcaatcacagctcctatggaaggcggcaggactcccatttcaaggtctgagctggagtgtgtacagaggactaggaagtggtagagcagttcctagaacttgagaggccctaggttcagtccttagtcctcctaacactactcaaatttacaatgaaaattagttctgatcttaagatttctcagtgtccttgactgtgagatacattttttggagttggggggaaggggggtgttgaccagtctttggtattttataaataggccaaacagacttaaggattctggaaacatagtctgaggccagcctggtcaatacagctagctccaggacagccatggctacacaaagaaaccctgcctcccaaaaatattaattaattaattaattaaagaaaaaagttttcaattacacattctatgacatctctgattgataacttttttgagacaaggtctcgcctcttagtctaggcttgccacaatccttccttagcctctcaattgttggtttacagatgtgagacatcatgcctaacataacattgtctttatttttatcagtaagaaaaagtaactgtcaaaaccaaaactctattatcctaagcctttctgaagagaacatcaaaagacttagaggactatttttatatttttatattgtttttccgtatttgaaagtacttaaaagaccacctcttaaaactcatctccagttgcaaaaatcagaacactgatgtttttaatagctgcatataaatataatataaatccattaacagtaatattatcaataataacaaacaaacctaattagaataaatgataatataccagtaaccattcatttaaggtgttggtttttttaaaggacatttgaaaagatcatcttaagctcttgaacagaaaaaaaaatagctatggccaattaaaaagaaaatgttcataaaaattgagagaaacaattattactgcaattatttgagggaagacacaaatgtttaagaaatacaactgaataaaatttacatgtcagagacattatagatacctaatgaatgcaatgttaaaaaaaaaaaaaaaaaaacgaatcaaatagaatgagttttgtctcaggtagaaatcacatttttctaatttaaaaccataaaaagggtaaatagccggtcctggtggtatacatttttaatcgcagaaccctggagacaaagccaagaggagagttagacgtcatccagcgatataccataagaccctttctcaaaaaaaaaaaaaaaaaagggtgatggtggctatttcagggataaaaaagccacctacaaaacctgcatacaaaaggaattttctaaactcaaagttaagctcctcagttatatgaagagcaacatccaaagaagtatgtgtataccacttcacaacacaccatgcaaggtaaatattgacacaaattatttcacaacctacattctgattttgaaaacaaaactacaagtcatctcatctttattatgtgctgtatctttcttaaacgatagactgcgaattgttgaagttctcatttttattacagattctgatacatggcttttttgtaaagctaagtatttatggatttacagtcatccttacttaggcttatcagcaatacagatgcagtatccacttccttaaaagtgcagtaagcagtctatttaagaggagaatttaatactaaagcaatttctgtcatacataacaagacaaaattttccttttatctctcctcaattctaaatttacataatttaccaaaaagatatcttaagagtattaactaatctgaggtgtgtcaaaaacattcgtcgtgtctcttgtccaatagggctttgatatttagctttttaacagctgtatttcttaaagttcaggccatctttatttcaaacgcacttccctatccaaaacattttaacataatctgctgcttctcccaaaaccatgggttatacgaatatccttcacgaagtaagataatggtggataacacatcccatatactatttagttaacatttccaacagtacactagctatttaacgcaatcccaaagagattttatactgttctattttagcatgctcaaaagacataaaaaaaattgacgtaaaattgtctttagaggattcttctaaagctgataaagtcttattaaaattatactttctatttttaaggctaacgcaattatagcacattcaactctgattcttccaacaaaaagcctccgcatcaaaatggggaaaacgtccttttcattttctcaactgaaaagggggaggggagaagaggaggaggccaactgcttacaggtttgcattgaaaattaacacagcagtttctgaggaatcagtaactcacgttcaactactgaatcctaccagaagcagcacacgaataaaaccagagcgcaatccttgggcttgaggtgccgcttcatccgtcttccttccaatccacccccaataccccaacccactaagcacacatctaaatatgtcttccccaccagagcgcccctttggaggaaaaggcctgcctttcgcagcctgaagccacggctggctctccgatctctgcttagatgaggcccccgatctcgacgccctgcacgtccgccccaccccgggcccactcgggtacccgtgggtgacaaaaccctccctcctgcgtccagccagcactgacagttaaggctgcagcagccgcagccaccagggcctagtcctggcaccggcccctccagaccacgcgccccaagcactcgctcacggaggcgggtgagggcccggcgcctaccctgtcagcgcgggccggagggtgacgaggggaccggcggtacagaccagagggagcgcgccgggcaggccgcagccgcagcagcactgacctgtcctcgcccccgcgcgtgggctgcggccctcgcagctgcggccgcctcactggtccttgtcgccctcgtccaccgccgccgcccgccaccgcctcgttccctttcgctggcgccaccgccgggtctcatgcgggacccgcgcttctcctcaggaaaccgaggccgagaggccaggcgcctgggcaaccttgaagtcggcgctgaagcgctgctgtcgcgatctgtccacagtggggggcgagggcggcgagcaactccgaagagaagcagaaggaggcgccaccgtcagcgacaggtcgacggaagagaagcgtaacgaggcggtgaacagctgcgtggcccggtgcgcgagcgagagagcgagcgcaggaggggcgacgaggtgctggcaaagacgaaaggccctgtcgtctcctggagtcacccaaagaggagcgccaccatcttgggagaaatacggatctcgcgaacgcagcactggacgagaggactaggtgggcggaccgagtatcccgacag

SEQ ID NO: 2 - DNA, 615382 bp, Homo sapiens
caccaagggctggccgcagccactgtagctgagctcagagccttctgtgtggtttgcgggggcaaggtcagctgccccctgccctctctctggggctatttgaggaatgcggcctttttgcataagaaaggcttttctctacagtaactgtggtcgctgatcaatgacaccttcctggtaacatttcatattgcttttttggaggtgggggtgcagatatctttaaaacttgcatgcgattgtctttcttttaatcacataaacatcatttaaaaccaattcatattttgtattgtatattaatgcctttcattcctgtattttaaaatgctatcataatcatttttcgaaatacatatttaattattttcatctgttcaatcatctttctttagtaattaaatgaaaatagcactttattaagaaagacaaatgttacatattctctgttttagtgttttccagaaatttgctatgaaatacgactggttgaaaaggagagggtcagagactttcctgagagccacaggacaaaatttacttacaatcgcaggcttaaagaagctatgatagtttaaattacgtggcttagtttgttcttattgtggaaggtgcacaaggaattaatttgtgtagacagaacactgagagtcccattctgaatgcagagacagctactttgctaccgtgcaaatgagtgtcgtcatattgtttgtttttctccttacccaaaagctatagacattggcttgcatatttgagtattttcactttggttttgtaaatggctgcttgacttgccttcctacagaaaatccataatacagagatgtattattttcttactcctttatgagtgattagtttgcactgaaataaaaatgccactcaggaaatgtcatacatcttcaagcagcatatattttaatagtatcatcttgtagaaagggaattacaatctttatttcttctatatcaatgagcaaactacttttttaatttttatatgttcatttttattgacttagtcaatagtttacctactttttaggttttacgtgctccattaatgtccattgttttaggctgaacctttgacactcctcatatatcgtttgtatgagactagatggcaagtaaagataggattcctcaccctaggttaaacactaacttcctcttgaagaaacaacttaggagtccaaaaagcaggctaggaattgtttaggttctgcaatacgaattgtgcaaatgccaacaggattgaattgagagaaacacattctctaatgaaggactcattcctgcagggtggatctatgagattcaatagcaaatggctgttatacaagtaatgaaatcctcaatcttatggtctaaaagcgattctggggggcacttatttaagatacatgagatgtgaaaaagcaatggaccaagagcattgatagtttatggatatttttatttcacattattgatagagctttgtttgccaggcaatgctgcagtcaggcactcggggtttcaataccctatacagaaaatctcaagagcagaccttggttaatttttttaagtaaccctcatcttcattcttttattgtattatgacctcgcgccattgaccttaaatttcactacaaatttagaagaacctaatagtcattgcaaactagatagataatggtatttatgtaatgaaggacaagggaaagatgattcccaaatctgaaagaaactagaagttttctggggaaacaaatagaggagataagatttactggtttattcttcattgatgagagttgcgttctgttctgataaatggaaagctccattgaaattacagatggtcctcaacttaagttggggctacttcccaataaaccatattgaaaatggtttcataaattgaaaatatcaccataaattgaaatatcataaattgaaaatatcaccagtcaaaatgtgtttaacatgcctaccttactgaacatcatactttagtctagcctgtcttaagagtgctcagaacacttatatttgcctacatttgtacaaaatcatctaacagaaaccatattttataatgtgttaaatatctcatgtaacttattgaatactgcaatgaaaatgaaaagcagaatggttgtatgggtactcgaagtacaatttctactgaatgtgtattgctttctcacaattataaagttgggaaatctgaagtcatacctcagggagtgcttttattacacaatacaggtttatcagacgcatataccaacaaatcataggaaattcaggtttgggtcaagggggaggggttcaacctacttatacatatttccttcctctctgttgggctacctttatccttgggattgttgcaagatggccgtgtcatgtaaagggctgtgtcttttagcatcatgaataagatgaaagagttgaaggccaacttcattcaaatgtcttctcgatgtgtccttccctttttctcctggactgctctgtgatccatgtctctgtagaaaatggctggcataagtcaatttctgactgggagctgtcatgattactgtctcccactgttaacactgtacttggaggtcttgatggaattgggcaaacctgttctttcagaccctcagtttcatctcaacacaaaactctccaaaagtccttgctgctccacagcagggaactctcttgaagcaataacatgaggaaatagtgggcttgcatggctgcctcacattcctcaggtatcactgtgctcattgcctgatgtactgtgtcttgccaaccatcattccacgtaatttacccattcttggtttttacattggttaaggcatgtacaaaccctgttagtttttctgcagtatttggattcataccttctgaaattacttgacgattactgtgtctctggttatttgcttctagttggcaatacaaaggaacaatgtgaatgaaactcataaagaaaaacctatgatttaatgggcgtgtgtaacactagagggaaggtcagagttagtctatgcatgggtataggtaggagtctcagtgggtgtcagccattctgtgtcaacaaatcaaatatttaaggtggatctaaaagaaaggtaatatctctgccaattaaactagagtcacgcattgactaatggcaaatacagtctaagaagtgcatttttaggcaattttgtcattatgagaacaacgtagagagtacttacacaaacttagatggtatagcctactacatggctaggctatatggtaaagcatgttgcttctaggctacaaacctttactgaactgtaagcaatgataacacgatggtgtcatatcccatatatatacacatacacacacatacatatatatacatatactatagtaaaaatatgatataaaacattttttaactggtactgctgtttaaagcagatatcatgagtggattttgcaggaccggaagttcatccaggtgagtgagtgagtgagttgtgagtgaaggtgaaggtctagggcattattgtacactactgtagatttaagaaacactgtatgcagccgggcgcggtggctcacgcctgtaatcccagcactttgggaggccgaggcaggcggatcacgaggtcaggagattgagaccatcctggctaacacggtgaaacaccgtctctactaaaaatacaaaaaagttagtcgggtgcggtggcgggcgcctgtagtcccagcatactcaggaggctgaggcgggagaatggggtgaacctgggaggcagagcttccagtgagctgagatcgcgccactgcactctggcctgggtgaaagagcgagactctgtctcaaaaaaaaaaaaaaaaaaaagaaacactgtatgcttacgctatactaaatttattttaaaaacctgaagtaggccaggcgcagtagctcacgtctgtaatcccagcactttgggaggttgaggcaggaggatcacgaggtcaggagttcgagaccagcctgaccaagatggtgaaaccctgtctctactaaaaatacaaaaattagccgggcattgtggcacatgcctgtaatcccagctactcaggaggctgaggcaggagaatcacttgaacccaggaggcagaggttacagtgagccaagactgcaccactgcactccagactgggtgacaaagcgagactccatctcaaaaaaaaaaaaaaaatcctgaaatactaatgacattatgattgctacaatgtcacaagataagataaattttcaactccattgcaatcttatgggaccagcaacgtgcatattgtctgttgttgaccaaaacggcccttatgtggtacatgaccctatacacataacagcatattttatatttatggaaaaagcccttctagaattataaaatcacaagttttactcacataaaatttaacacaatattgagattaactcataaatgaaattataaaagtcttaaaattttgactatgatagttctaaacaagattttaatccagagaaatgaatgtgttcacgtaatcctctgtggcataaagagtaatggcaatgaaacatttcttaataaaacaggctgcatcattgtcagtgcgatttgcaccttcccgttgacatccattctgtaggtattgaatgcaggtgatcttacctgaaggtgacaacagaagattttattacaagatcacgcatgtgccctcaataacgccatgtcattgatgccaccagggtaacagctattgtgataaaatttgaaaaataaacatatgtggcttgaacccgggaggcggagcttgctgtgagctgagatcgcgccactgcactccagcctgggcgacagagcgagactccgtctcgaaaaaaacaagaaagaaaaaagaaagaaaaataaacatacgctaaaaatttagaaggatagtaagtaataagcatttgattgcttgagcccaggaattggaggctgctatgctctgtgatcacaactatgaatatccattgcactgcagcctgagaaatatagctaggctccatctctaaaaaagtaaataactaaataagtgtttgaaaatatttagcaaggaagccatactaatgtagctgaatcttggaaatcaagaaaaaaaattgttcgtttaaaagggcaaaattaaaaaattctttccagatagaaagaataggtgcagatgatagagcagcgtggcccaggggaggggctaagcagtggactaaggatggggaggctggagaagaggctgaggggagtcacatgttgtcctgagatgagaaagggaaaaaaagaaacatgttcatcttcaagtgcaaactctcttcagattgaaagaaagtttttagtttcttgggaagcagaaaagaatataggtgaggagtttgagagattcattaatttctttgtgaaattcaacataaaggaagatattctgtgttgctctttgttcactatatgtgtggggctcacagggaagcaatatagacaaagtttccaaattctcagatgttaaaggccaatggggattcagaaaacgcaacagaaactaaactgcaagtggaagagctgcccttgggagcccagagggcaagtttcaggcctggactgggtgggcaagggaggcctccaggaggaggagctttggaggagattgtggagagtgaggagcagtgagtccagcaaacagggcagggaaagcgaggaggaaacagtgtgtctgtggcacaggccagggcatgagaagagggtggtgggttggaaggaccactgggatgagtaatacatgaggaggcaggagaaggaagggcagaccatgcagggactgggcatgggggtgagggtgccgggcagctcagaaagtgatgcaggggccgctctctgaggactgcattctgtggggagggatttgaatgtctcagttcttttatgaaatgttatccccaatccatgaggtcttctgattcaggaaccagtcagaacaggtgagggtggccccagtccactgtgcaggaccattagcattgccaggaggggttggtgctgaggacaaaagagagtgaaaaggggcaaagaactttctttcctgtctgtcattttgcagatgtaagtgggatctgtggatctgaaaattcacagtggccagctcaccaccacctgatgaaagatacaccacagggtgagagcatcctaacagcaaactgcaaatgaggtgggtttgcagctgcacagagaagggaccccagggaagctacacgggcaaggcaggcaggggacttcagaggtggtagcagtgggtgttgatgaaattattctctgaggatatacacgtttgtcagtgtacgtgcatgaccgcttacatgttgatgttcgcatacaaaccccacaattttctcatgtttttcagagcatagcatgtattttgactttattctttctaccacacgtaaccatgccttgtatacctagcaatacttaacgtttatttttggtggattattcatggttaatgcatttcctgacttggtagccaaatgaaattaccttgctttacaggcctttggttgatcatttctgaagatttgtgtcgcctgaattcagtgggggtcacctctccatgatcttaagcaacagtcctgttgggactgttatgctatcctacttaactttggacttgtatgtcctggaaaatatgaaactatcgatactcacttgaaaattccaggtgctttaccttttactttgtttttgccgtgtttccaatgttatatattttctcccacttactttggattcaattgctctgcttccttttacagtaaaaatttagatgtttgaattttgggtttcaacttttctaatatatacacactcaatgctgtaattttcctctaagcttccctgttgtagctgacaaattttgatgaggtgtgttttcctttcaatttagttcaaattattttaaaaaatttctcttgagatttctttgacccatgtattatttggaaatgaattatataatctccacgtattttgcaattcaccagtttttaaaaattgatttctagcttaattctgttgtgttttgagtgcatacattgtattagtctgattcttttaaatggtttcaggtgtgttttatggaggagaatgtggtgcatctcgatgagtggtcctgtgggcttgagttcaatgtgtattctgcccgttgttggataaagtctgtagatgtcaattatatccaattgactgatgatactgttgagttcaactatgtccttactgattttttctgcttggtggatctgtctatttctgatagaggagtgttgaaagtctccaacgataatagcggattcatctatttcttattgtggttttaacagtttctgcctcacgtagactgatgccctgttgctctgttgttacatgcatatatattaaggatcattatattttcttggaaaatcgatccctttattatcacataaggtctttatccctgataattttcctgtatttacattacattctttctgaagctaataaagctatgcctgctttcttctggttactgttagcaaggtacattttgtttcattcatttacttttatatgtacttttactttttttacatttactcttattaattgacaaaatttgaggtattgactatgtaaaatcttcacatcatcttcaaacatgatgtttgaagaataatatatattgtgaagtgaaaaattcttgctaagaacatatgtgttacctcacacagttatttttcgtggcaagaacactttacatccactctttcttcatttttcataatgcaatttattgttaactatagttaccatgttgtacaatctcttgatctttttcttcctatctaactgaaattttgtacccattcacaatcatctacccatcctcatcccctaccacccttaggccctagtactcaccattctactttgtatttatataaatgagcttttttagattccgcttacacatgggttcatgtggtatttgtctttctcttcccggcatatttcatttaacatattgtcatgcagatacattcattctgcctccaatgacagtaattctccctttttaaggccgataatatcctgttttgcatatacactgcattctttttatccattaatctgttgatgggcacttaggttgatcccatatttggctattgtgactaattctggaatgaatgtgggagtgcagatatctatccaacacaccggatagtcaatgaaatctcccaaggcagattttattacctttggatatatacccagtaataagactgctcgatcaaagggtaattctattgtttttttttttaggatccttcacaatttttcccataattactatattgtactaatttacattcccaccgacagtacacatgttcccttttctccctatctttatcaacactaacttttgtcttttaaaatagccattctaacaagtgtgagatgatatctcattgatttaaatttgcaattgtctatgtatgtcttcatatttatacagatttccaatatacaagatataacggggacttgtttttagatctactctgacaatgtgtctttaattggtgcatttcaaccattgctactcaaagggattactgacatggttgtgagaggtgaggccagctggacttcctgggtcgagtggggacttggggaaatctcctgtcttacagaggattttaaaatgcactaatcagcgctctgtaaaatgcaccagtcagcaggattctaaaagtagccaattgaggggaggattgaaaaaagggcactctgataggacagaaatggaacatgggtggggacaataaaggaattaaagctggtaaccccagccagcagccacaatccgctggggtccctttccacgcaatggaaggtttgtctcttcgctcttcacaataagccttgctaccggtcactctttgggtccatggcatcttggactaagagtccaaggtcagttcaacttggtggagcaagctggcagttagatgaaaaatatacacagacttgctgcagctgtacagatgatgaacgtagaactcaaaagatgatggaggccgggcgcggtggctcagggcctgtaatcccagcactttgggaggccgaggcgggcggaccacgaggtcaggagatcgaggccatcctggctaacacggtgaaaccccgtctctactaaaaatacaaaaattagccaggcgtggtggcaggcgcctgcagtcccagctactcgggaggctgaggcaggagaatggcatgaacccgggaggcggagcttgcagtgagccaagattgcaccactgcattccagcctgggcgacagagcgagactctgtctcaaaaaaaaaaaaaaaaaaaaaaaaaaagatgatggaaacagagtagaaatgatgagaatgatgaatgatgcctggagcttggttcctgggttgctgtggtgttagatggtcacagagcagctttttggaagcttatgtccatgtctcctgctaacagtagatacttgattagaatggaacagaatgtttacctgatttttacttatagcacctggaatgctagtagtaaaatgtaagccctttggagacagaaaatttttcaattctgtgttttcagagcctaggataattcctctgacctcactggtgagaatacgtaggtgttaaactaatgcacggattaaactataagggcaaagaaaaaagttcccctttgtcctctgaaggttcactgaaaaatcaactggcaaaaggaagattaatagaagaaaaggtatgtaaaattttattttaaattgcatagggagggaaccacaaaagaatgatgacccagtgaggtacacacgtttatatatctgttttcatagaggaagaaggcgatgtgtaacatagactattattttaagaggcaatagaccatcaaggagaatgaacagacccaggaggcaggaagcagacattaggagaaggtgaggtgcagagctacgcaggaagagaggttgttgtttaatgcaaattaagtcctccagataatctcttggagctgacctcaaaagaacagacggtaggtgtgtctgggctggtgaggactcccagcctcttgatctttcctggttacttgatgagatccctggggaggatgttcaagaccattgcatttctttattttattttattttcagatggagtctcactctgttgcccaggctggagtgcagtggcatgatattggctcactgcaacctccacctaccagattcaagtgattctcttgcctcagcctcctgagcagctgggattacaggcgcctgccaccacacccagctaatttttgtatttttagtagagacggggtttcaccatgttggtcaggcttgtctcaaactcctgacctcgtgatccacctgccttggcctcccaaagtgctgggattacaggcgtgagccactgtgcccagcctgtaaatgcccatcccattatatttcttttgtaaagaagcttgcttggtcagataaggaaatttcagagaggctcttcctggacttgggagtgggagacaagattagagagaccttcattctgaggcaaattctaagacggctcagcatgacaaagcaccagtctttggtatatctgagccccaacaaaataaactgatttgtgtatgaagaatggagcttacagctcagacagcaaatcaatccttattgactcagttttcaacttcatctggattaccagatgcacagtgtgaaaataagtcatttgccagcctgagcaacatagcaagagcccgtctctataaaaagtgtaaaaatctagctgggcatggtagtgaccgtctgttgtcctagctactctgcagcctgagatgggagcatcacttgttacagtgagctgtgatcatgatcaggtcactgcactccaatctagctactgagtgagaccttgtctctctctctccctctctctctctctctctctctctatatatatatatatatatatatatatagccaggcgtggtggcagtcacctgtaatcccagctactcaggaggctgaggcaggagaatcgcttgaatctggtaggtggaggttaaagtgagctgagagtgccactgcactccagcctgggcaacagagcgagactccatctgaaaaaaaaaaaagaaatgcatataatatatatagtatatatagtatatatatctatatataaaatagatatatatagtatatatatctatatataaaatagatatatatagtatatatatctatatataaaaatatagatatatagtatatatatctatatataaaatatatagatatatatactatatatctatatataaaatatatagatatatatactatatataaaatatatagtatatatatgaaaataagttatttgtattcaaagcatcaaataaaattttgttttagttttctaaaaaaatacaagtaacatatataggcatgctgtttttcttcttatatgtgactacattactttagtatgtagcaaatatcatttgctagctgtagtaaatgtgcattgtcacattttgtccaattttgttcaaactttaatcaaatgcctaagaatttaaaattaccttaattttgtagaagcaaatcacagcttatcattttagatgttttacttacttatgagtctactatttcccacgttactgctgtttctggcctgcctgtggcagtattgccattcactggaacctgcttccataggaggagcatcctgatgtgtttaggaatactaaaattcagatcattccccatcagagttgtctattctgtttctccctctcatccccataatgaatgcatacattctttctgtttgtttggtaattattgggtcatttaaaatgaagactatgaaatgagaacagaaccactgaccaaaatgtacaactttttaaacgtaccatggggaagaaaggtccagaacctatgcgcggagtatgttactaatccagagagaaagtatatttaaaaacaacctgagtggtcaggaagtcaatttcttttttctttatttttttaagagagacagggtctcgctttgttgcccaggctggtctcgaactcctaggctcaagccatcttccctcttcggcctcccaaagggatcagtttctgaagtgagatgagtgagttgattccttgagcattgtcttaatatgctacggctaccataacaaagtaccagagactgggtggcttacgcaacagaagttaacgttctggaggctataacgttctagaggccggcaaggttgtattctttgtgacctctctacgtggctggcagatggccaccttctctctgtgctctcacctcttccttcccctgtgcttgcacatccctggttctctcatccaagcattctattcttatagggacaccaggcagataggatttggcccaccttaatgacctcatttaccttaatcatctaatagaaggccctatgtccaaacagtcacattctgagacactgggggtgagggctctgcaggggagaaaaataatacctttccttcacctgctgcaaggttcgtggctgagtcctcataacaaaatccagattaacaaaagaaaagtatgcaaatgcattttttttttgagacggagcctcacttctgttgcccaggctggagtgcagtggtgtgatctctgctaaccacaaactctgcgtcccgttttcaagcgattctcctgcctcagtctcccgagtagctgggactataggcgcccaccaccacacccagctaatttgtgtattttttagtaaagatggggtttcaccatgttggccaggctggtctcaaactcctgatctcaggtgatccgccctgctcggcctcccagagtgctgggattataggcgtgatccaccacgcccagccacaaatgcatttaatgtaagttttatgtgacacaggagactacggaaatgaaaactcaaacatctagggagaactgtgcatttttatggacagtcatttagaagtatgattggaggacaaaagggtatgatctaatggtaataaactgggaggaacttaccaaggcctgactgttcaggttcttcttggcctccaagtttgatattccttcccttcgggcatagggcagaatacctgtcacatgagggtcttcaggagagaagaggtgggagcaggtcatttcaaacctttctccctctggagttttctgtctcctccagcttaaaatccttagtgtgccagggtgccatacattggggtagtatttcctgtactccagtagcttcaatgtataaatcttagccacaacaagcatgaatagagatttcaagctacagaaggaagcaaaggactaccgagaggtaaagatgtccaaaggtaactctggcgaaaagaatgaactccttgtacagctgtgaatgggagtttgggcaagcgttaagtctgaacctacctataggtgggactcttaaccattttatatttatgcagagcgagtaaatggaaaaatcccgtggaaaaacactaatcatatattgcgacttgagggggctacagatttttttttttttttgaggtggagtctcactgtgtagcccaggctggagtgcagtggctgcgatcttggctcactgcaagctccgcctcctgggttcacgccattctcctgcctcagcctcccgagtagctgggactacaggcgcccaccaccatgcctggctaatttttttgtatttttggtagagacggggtttcaccgtgttagctaggatggtctcgatctcctgacttcgtgatccacccgcctcggccacccaaagtgctgggattacaggcgtgagccaccatgcccggcttggggggctactgatttaaagaaagaaagattaaaaggattttgatgcaataactctttaaattttttttttttgagttggagtctcactctgtcgcccaggccagaatgcagtggtacaatcttggctcactgcaacctccgcctcctggttcaagggattttccagcctcagccttccaagtagctgggattatagcatgcaccacaatgcccagctaatttttgtatttttagtagagacagggtttcaccatgtttgccaggctggtcttgaactcctgacctcagaagatccgcctgcctcggcctcccaaagtgctgagattacaggcatgagccactgtgcccggccaactctttatttatttatttttttttttttgagacggagtctcgctctgtcgcctaggctggagtacagtggtccaatctcggctcgctgcaagctccacctccctggttcaagtgattctccagcctcagcctcccaagtagctgggactacaggcacctgccaccacgcccaggtaaaatttttgtatttttagtagagacggggtttcaccgcgttagccaggatggtctcaatctcctgacctcgtgatccacccgcctcggcctcccaaagtgctgggattacaggcgtgagccaccatgcccggcgccaactctttaatttttaaaattgggtttctggaggtgatatccatccttttccagtacacagtttatagagtttcaacaaatacatactgtcatgaaattaccaccgtaatcaatgtttcccatagtggccacagcttgggaaatcctaacaaaggctttaggcttcctggcctctgctgccatgaccctgtagaaagaatggattacgagattcgttcccacctgcccctccctgggtctcagatcttccctatctatcagataaggattggattgagctggtgtagccagtttgtctgtccctgtgctgaggttactacttctgctggcacccaaagcacttgttatagatctaaacaagttgatttcagtcatccagtccagcaagggaggacatgtcctatataaacttgatgtgcctgataacataagccaccccactggaagtatcagatgtttcccgcactactagagggttcctagcaccctggtcctccctgatcctgtcccccaacactgtgagatcccatagaaagtgggggtcaccttggggaacactgccataaaattagagttagggggccctttctggggttttatggtggcctgaaccacaaaccacccccaagaacatgcactttgaagagaaaaggaaaaagaatggtagggaacactgaggttggaatttcacaggaacagcctaattagccagctacctggtccacctccatccacatcaagctcagtgtttcccaacatgtgctgcagtgccccatttcccatgcattggagtgtagtgtttagtgttcatactactagatagaagtaccgcctcctgagcaggccttcttgatgtcctatcttcagttgctttggctgttccattgttcagtagctccattggcttgcagatgacagggtgcatacaaagcccatcatattccatgagagcatggccattgttttgctggtcatgtagtgaaggatgcttcttggtgagactgaggtcctctggggtgttcaaaatcatgacataagttctcctcaataacagcaatggtagtatcagcatccacaagcgtgcatattttttgtcctttccaagtagcaagctgttttgatagtctttgtccccacaaagaggctctttaaatattctagtcactcaattgccattccctgatgaggtatgtaggctgtcagcaacggcccacacattggtgaaatgcaggaagacctggtggtaggggtggcctgcatggtcatcacaaatgcgtgttgtttggtccactgggcaaattgccaaggtttattctgacaaatgatgatgacaaccacagcctaacagaccccatctgctctgttgtttcactgagccatcagtaaaccatgccacaccatcagcaggcttgtcttggagccttaggctccagacagccatgggaggagccaaagcacacccagtggttctcttggtgtcttctaattagctagccatttgttcacggagcctgctggtcacatgtggtcctagctgggcctgaacttgaatgcaccacttccatttgataagtgaagtctatggagcctgtctaattttattggttgagcttgtgagccatccagagagaaatggcagttcaggttgcagagtttcatctggcattctggccacgaggtgcccagtccaaaacagtacccaatatcaagtaaggattgccatttaaaagagggatataggccgggcgtggtggctcatgcctgtaatcccagcagtttgggaggccaaggcgggtggatcacctgaggtcaggagttcgagaccagcctgaccaatgtgatgaaaccccatctctactaaaaatagaaaaattagccggacatggtggcatgcgcctgtaatcccagctattcaggaggctgagacaggagaattgcttgaacccgggaggcagaggtttcaatgagccgagattgcaccattgcactctaacctgggcaacaaaagtgaaactccatctcaaaaaaataaaataaaataaagagggatatttggtggctgcctgaggcaacttatgtgtccaagatctgagaggctggtacaccccagtgtcagttttctgttgccagagacatccatcactgtgcatcaggttgcacacaactgtgatttcatctggctagcacatttaaggtttaaaaggaagtgcctgagacacaaattgttgtaaacctgctgctgcaaagggttccattcaaagtgtgtggctttattggttaccttgactctgggtgccagaagaacccccatgtgagatgcatgttgtctccagtacccaaagcgacctaaccagctgccaggcctcctttgtatccgtgagtgcagccaggggcttgcctgtatctgggatactgttttggcttcttgctcaggtagctttggcattcattgtgcccatggcctttttgaccagctaaactgggctgttacattgtgacaggtgggttgtcacttttttctttttttcgagacggagtcttgctctgtcacccaggctgacctggtgcgatcttggctctctctaacctccgcctcccaggtttaagcacttctcctgcctcagcctcctgagtagctgggattataggcgcccaccaccatgccctgctaatttttatattttagtagagacggggtttcaccatgttggccaggctgggcttaaactcctgacctcgtgattcacccacttcagcctcccaaagtgctgggattacaggcatgagcccccacggccagccggttgtcacatttttatctgtaacaagtaaatccagaattaataaaatagtgtcattgttccatttagtatgcagtaccactttttttaatgattcagtgcggcttgggtagcttaggtaacaggcaggagtggatacggcccactattgtgtcttagttcttagctgtgagggggcataatcttccaggacatcaatgcctataatgcactcagggtgggaaccagagccacctgcataaaaagttgctcacagggctctacccacaagtacataagcattgtgtgcagataagcatcacgggccaccagtttgttcccaaacctcccaatgtcatccgtttaattattctcctaaaaggacccagaaacattgtcatgtgggttccggtatccaagcacctgagaaaaaactgaagtcttctcttttctcctcttatcataacaagggtataaggccagagggcttcagtagggacctagaggccttggccccattcttaactgtgtcaatcagaccaagacacttaggtggcagtgttcctttatcaaacactcacaatagccacactgcgtaagatttccctggtcttcctccttatcctttcgagcctgactcttcccatcttctgggctgacattgtacgtgttagttcctctcatgcctcagggaccatacaaggacctctctctagtttcttcttgggtgcctcaggggctgtctgaatactcaccattcaagctcttgggccctgacaataagggatcacataagtgcccagcacctaggggaccttgaactatgatctgctgtttccacattcctttctctctgtctcagtccatgcagccagctcacttacatctgtggggaggagagtgacatgtcccatttaccacccatccttatccataactcatccaggtacatgtccagcccctgtgctcctgggctgatgtctctgccttgggctgagtactgggtggtattgcccctcccactttgccagaaagccatgtttctctgaccgaaccttacccactgcaccaatttttcaaagcaggttcaccaattaccaatcccaagggaggactccaccacacagaggacagcaaaggtcatcactataccagccatcaggaataggagtccagacacttctacccactgcatcctccgctgcagtgctacaactgcctgagagcagtgagacagaacacattctcaggcagtaagttaaaggatgcacatttattatttacagatagggagaaagtcttccttcaaaagaagcctaggctccattctgagctcatccccaaaggctcaagaagggttcccagggcagatgaagtctggattgcaaatgcccccctttcacacagctgaggaagcccaaaaggcagcccaccctgggttacatatctcagggcagacatggcgcattgagcaaagctttaaggaaatactgctttcagggcagagaggaacaaaccccagctctcctggacagtccctccctaactaaagatgtgacattccttaggaagggccagaacaaggccagggttgttccagacagtccctccctagctcagaatattgcattccaggctgatgctacacttattcttgacaaattaaaactgagaaaatgggaataattgaatccatccaaggccacctggaggactgttttgcattttcaccccaaaagttccttgtagtagtcttcccaccatatttagttttggaaattattgatatctatctccataactttgccttttacagaatgtcatataaatgaaatcattctgtatgtaatctttcagtaacactttcgagatatgtcatgtttactgtatcaatggtttgtttctttttgaaactgacctgtgctatattcaatgaatgtaccacaatttactcaattgtttatgtttttttttaagacagagtttcgctcctgttgcccaggttggagtgcaatcctgcaacctcggctcactgcaacctccacctcctgggctcaatgattctcctgcctcagcctctggagtactcatcatttttattaatataaaatgttataaatatggataacttgatggatatttgtgttgaggtattatatggttactacaagcatatggtttcattcatcttgggaaaatagatcttagcgctgagatgctggatcatataacaaaagtatgattcagaaggctggttgtggtggctcatgcctataatcccaacactttgggaggccaagatgggaggatcacttgaggccaacagttcaagagcagcttcgccaacatagtgaaaccccatctctactaaaaatacaaaacttggccgggtgcagtggctcatgcctgtaatcccagcactttgggaggctgaggcaggcggatcacctgagatcaggagttcaagaccagcctggccaacatggtgaaaccccgtctctactaaaaatacaaaagaaaattctccaggtgtggtggtgcatgcctataatcccagctactcaggaagctgagacaggagagtcacttgaacccacgaggcagaggttgcagtgagccgagatcataccactgcactccagcctggatgacagagtgagactccatcacaaacacacacacacacacacacacacacacagaaaacttagctaggcgtggtggcacacgcctgtaatcccagctcctcatgtggctagggcatgagaatagcttgaacctgggaggcagaggttgcagtgagctgagatggtgccactgcactccagcctgggcgatagagctgactctgtcttgaaaaaaaaaaaaaacgtatgattcactttacaagaaactgccaaaatgttttccaaagtggctatcattttgcatcctaacagaaaatatgggaatccccgttactccacatccttaccagcacttggtttggactctgtgtgtttgtgtgtgtctgtagtgtgtgtgtgtgtgtgtgtttgtgtgtgcgcatgagtaaatatatgtgtatatatgtatatatatcgactcttaataattccagtagggacatagtggcaccttactgtggtttcaataatttacatcttcctgctgataatggcattgaataaaactcattaacttgttcgtcatccatatctactatttgactgtcactcttctcatttcaaaaaatgtttattgttgtattattaaatttaactatgtatatgtataattttgatatgacctacatctgttaagtaccgaaaatatttttttctgagcctgtgccatctcgtctttctcttaacagtgtctgtcaaagagcagcatttattttaattttgactaagaataatttgtccttttttgttgtttttttttgagacagagtctgtctctgtcacccaggctggagtgcaatggcacagtcttggctcactgcaacttccgcctcctgggttgaagcgactctcctgcctcagcctcttgagtagctgggattacaggcaccctctatcatgcccggctaatttttgtacttttgtagagatggggtttcaccatgttggccaggctggtcttgaactcctgacctcaggtgatccacctgcctcagcttctcaaagtgctgggattacaggcatgagccactgtgcccagccaatttatccatttttaaattttgtgcttaatatttattccctaccattatatattgcttaacacaaggtcataaagattacctacagtattttccttagaaattttatgtgttaaggatttacatttatatctgtggtattttgaattaattttatatctagtgcaaaaaagggtgaagagttttgttttgtattttggcatatgaatgctctgttgttttaggagcttttgctacaaatactctcctttcttcaattcaagaaaattgaatttccgtggcacatgagtcaaaaacctaccaaccatatatgtatatgctataatgctccagttatctaaatatttatccttatacatatccatatatgaatatgcatatgctatacatacatacatatatgtatttgctatactgttccatttatctatttatccttacaccaataccacactatcttgactaataccacattatattaaacttgaaataatggccaggtgcggtggctcacgcctgtaatctggcactttgggaggccaaggcaggcagatcacctgaggtcgggagttcgagaccagcctgaccaacatggggaaaccccatctctactaaaaatacaaaaattagccgagtgtggtggcacatgcctgtaatcccagctactcgggagtctgaggcaggagaatcccttgaacctggcagacggaagttgcagtgagccgagatcatgcagttgcactccagcctgggcgacaagagcaaaactccgtctcaaaaaaaaagaaaagaaaagaaaacgtgaaataagtagtgagtcccccaatattgtcccttttcttctaaattggtttggctatactaattatttagtttcttacataaattttggaatctacttctcagtttctaaaaaaaatataaaaaatcagctgaggattctactgaatgtatagataaatatgtaagaattgacccttggtcaggcgtggtggctcaagactgtaatcccagcactttgggaggctgaggtgggtggatcacgacgtcaggagcttgagaccagcctgaccaaggcatggtgaaaccctgtctctactaaaaatacaaaaattagccgagcgtggtggcaagcgcctgtaatcccagctactcaggaggctaaggcaggagaatctcttgaacttgggaagtggaggttgcagtaagccaagatcgtgccactgcactccagctggggtgacagaacgagactccgtctcaaaaaaaaaaaaaattgatccttaatattgagctttccaatccattaaattggtatatctttatatttatttagatttttttgaatatcaatctgatcagcattttctaattcccagagcacacattttgcacacattttgtcaggtttatctcgaagtatatcacgtttttatgctattataaaatacattttaacttctatagtcaatttttcattatcagtataaaggaagtcaaccgattttcactcactcatttttacaaactaagcaaatctagtggcagccatgtggtatatacattgctacttgtgagggatggataaatgaaaaacatttctcctttatttgaggcatttgtcaagcagagatatgaacaaataggcaatgcaaatcagaggggttgtagtagggaatgtgcattattctgtggaaatccacaaaatgcatgggcatacaaaccaaatttaaatagtcatagaaggaatcctgcaggaagtaatttatgattgaataaagtagctgaaaaccatgcaaattagaattagacaagacaaaagaaggattagtattcaggtagagaccagggtgtgtctacaagtcaacatttttgagacatcacagggagagtaacaatttcagtacactgaaggaagttagaaatctatgtcagggctagatttttaagaaattttgttctgtgtcaataagttaggatttttatagttttctaaggttctattcagctactatggggtcgactcaagaatacagctgttgtaattgttaaaatgggaatttgggagtcttttgaatttgaaagaaaaaacaaatgtgcgggattgaggctcagaccctgtacaggcaaagaaaaagttaaaagtgaggaaaatgagagacaacataaactctgggaaaagtgttcacaaaaaattttagtattttcagggtagaagctcctcttgattgagtcataccttcctgcgaaagatacaaagtcagaaaagaaatcctctacctagaaaacgacattttggcaccaagcataggttactttcatgccttaatttcaccttaccagcatttcaaaatacctgctacactgtggtttgaggaatgagactactatgctcacagcgccacctagcatcaacagaaagggaggcccatggcaaacttaataacaagaggcgggaaaaaaaaggtgaggcccaggaaccggaaacttaatttgagcaggatttttcttatatttatttaaaaactaaaatattggccgggcactgtggctcatgcctgtaatcccaacacactgggaggccgaggcgggcagatcacttgaggccaggagttcaagaccagcctgggtaacacggtgaaaccctgtctctactaaaaatacaaaaattagtgggcatggtggcgggtgcctgtaatcccaactactgggaggctgaggcaggagaattgcttgaacctaggaggtggaggttgtagtgagccgagatcgcgccactgcactccagcctgggtgatagagtgagactctccctcaaaataataaaataatattgctgcaggggtcagtggtgaaatgcaatccataaccattcccagtaaacactcagcgagtcctggcccatgcccacttttcctgtcatttaacgcaagggttaaatatcaaagtgaatcccattatgctaattgatttacaaatacggatgtataggagtgtgataccctgagcgcaatcatacttcggatataactgtaaaacgacttcagctgactttgcagtgttgcagtgtcacattaaaccctaagttgtttgtgtttccctacacatcactctccaggagcattatagttcagaagattagagtaatttcttagactaaagccttgatgggttattattacataaaacgttttccactctgatggagaagtcaggtgcattcgctcatgtctccgtggcagggccgggactcctggtcccccgcgattctgagcggtgcctcacagcctaggtcctccaacctcacagggcggcccgcagcaaatgcgccactgtccggtgcggccaaccagctcgtggtgcgctgtgggaaggtcacaggacggagctggggggcgggggcggcggtgggggcgggggcggcggcgggggcgggggcgggggcgggggcagatcctatttgcgcctgcgcgggactggaggattcggtgttgccctttccccctgctatttccgtttccgcgcttcaagcggatctcttccggttatggcgcccgctgggagtgtcttatcagccgcttataccgcggaaactttaacctgcgttttcccgtaaaattttcctctctaggtttcgtatcattgtcttgtttcttactcttgtattaactttgttttaacctaaggtttctctttcccaaaaactgtggtgtttctttacaacctctttttatagttatataaacattgcaagaaccatgattttatattcttccttttcagtattaataacttcaatgtcttttttggcatttgtctgaaaatttgaaatatttttcaatttactgaactgattatcgttttgtaaatatcggatactactttaatcatttgtgtattggccttaagattctctatttttaactcttccaccaacatacctttaatctgagaggtgttgtaggggcttcaagatcaaactttccccacagtctctattttcattataaaataccgtgttttaagaaaaaatgtacaaggttgaaagaagtttcactactacgtgttttttttttaatttttattttattttattttattttgagacggagtctcgctctgtcaccaggctggagtgcagtggtgcggtctcggctcactgcaacccccgactccctggttcaggcagttctgccgccgactccctggttcaagcaattctgcctcaacctcccgggtagctgggattaccggcacatgccaccacgcccagctaatttttgtatttttagtagagatggggtttcaccatgttggccaggatggtcttgatttcctgacttcgtgatccacccgcctcagcctcccaaagtgctgggattacaggcgtgagccaccgcgctcggcctctactatgttttaaaacagtggctaggtcatgcttttctgtgtatccttacttcccttattccatcacctcatccatcactttacaactgatcatacaattacaaaattattttactaatcagattaaatgtgtgccttccatttgaagaagaaaggtctactaaaggcttagttttccctaggacactgggagaatacaggatctggtttccagtgccacagtggtgatcacacaggaataaacgggacacaggtcagacaacagccagaaagtcatctgccagtatatgtttcctgtgagatggacacctggtcccaggtcagacacaggtgttagagtgtcagctaggtaaaagaagtaacctgaaagagacacgctgtgaacaactatgtccacctccccttcatttcctagtattggagggctgctagctgctctgttactaggacccagatttagttggggcctctcagaacaggtcagaattgacctatgcacagtacctgtgggagtctggatgagggccatccactgaaagttagtgaatcaaagatttaagattgatctaaatgcaaatagatctgtgtcaaacgactatacgcataattgccttattttatacttattgaaaaaatcctcgtaaaattataaaggcataagatttacttgttatgaaaatgaaggcaataatgaacgtaattcataagtgaatttgcaaatatcttgaaattccaattctgatttttccaaattagattttgattcagagtcatcgatgtcttcacaccaccctctgtggcatgaacagagatggtaatgaagcatttcttagaaaacaaggctggaccactgtctgtgtgatttccacctttcttgctgacaccattctgcatgttttgatgtaagtgatgttaccagaaggaaacagcagaaggttgcaaaacaagtgcaaacaatgaaagccatgtcatggctgccaacaggctaatagtgattgtaacaacacttgacaaaataatttttaaaaattattcaaatatgataactaataacgatacagaattatcaagggaggtccaatttttttttttgtctgagacggagtctctctttgttgtccaggctggagtgcagtggcacgatctcggctctctgcaacctccctgacccaggttcaagcatttctcctgcctcagcctcctgagtagctgggattacaggcggctgccaccacacccagctaatttttgcatttttagtagagacggggtttcaccatgttttttggccaggctggtctcaaactcttgacctcaggtgatccacccgccttggcctcccaatgtactggaattacaggcgtgagccactgcacccggcctaagggagctctattaatggagctgaatctatgaaacaagaacatcttccttcatcaagggagcaaaactgtccagaaaaaaagtacagatgaggtagaaggagcctggtctatgtgttcatctttgtggtggattgagaatagggaggctggagaagaggctgagggggaagtcagggctcactcctgtcctaaaagcaaaagggagcaaaagaaccatgttcatcttcagattcacacattcttcactttgaaagaaaatttaagtttattaggaaaccatatctgtgaggagtttttattttttttttgttttctttttttgaaacagggtcttattttgttgcccaggctggagtgcagtggcatatacactgttcactgcagcctctacctcctgggccctagcagttatcctacctcagcctcccatgtagctgggaccacaggcatatgccaccaagccctgcctattttatttttttgtaaagacgtgtctcactttgttgcccaggctggtggggggaagttttagagattcattaaataatttgtgaaatttaaaataaaggaaaatattctgttttgggttttgcccagtgcatgtttggggctcataggtgaacaacatggacaaaataacctctgatatttcagtccagtagtgattcaaggactgtaacccaaatctcaaatgtaggagttttgggttacaaaacttttgggagctgagagcacaggcatcagacctgaaatggaatggacaaggaaggcctctaggaggaggaacattggaggaggttctggagagcgtggagcagtgaatctggcaaacaggagaaagagaagaggaaaaaatgtgtctgtggcacaggccagggcatgagaaggggacagtggattagaaggactgctgggattagcaacatgtaaggagggcaggagcgggaagggcagaccatggagaggctgtgaaggggagagtgggcaggtcaggaagtgacacagggccggccagcccactaaggaatgcatttgttgtgctggtagttcaaatatcagtctcgttccttgcaacagtacctccaggtcaagaagagtgaggatagcctctgtgtctgaggaggtccctgtgcattatgaggaattggttctaggaagaagggagagtgaagaggaacagagaggaccctccagatccagtacgggccaactaagggaacttggatgctcctgttcatgtccctttctccatcactgagactcgccccatcccaccctgaatgcaggttcctttcccctcggttattttgtgcgtctcagatgatgacatgtattgtaactttattctatcacatatgacttttacattatatcatagaaaaagttacttacataaattacttaatggtggattagtcatagttaaaatgttgtcagcttggtaaacaaatgaaattatcacactttagtttttcttcgttgatcatttatgaagattagtgtctcctcatttcatggatgtcacaactacatgttcttaagtaaggtgtatgcttggggtgttgtgttttccctgttaatgttggatactccagtgttcagcaaactataaacctatcaacacacatttgaaaaatccagttgttttgtgttttatttcgtgtatcctgtctttacaatattatatcttttcttctgcttacttgaaatttaatttgctcttctttttctaggttcctaagatggaaacttaggcgatcattgggcatcatcatagggtctacctgccaaatcaggtcttcttcattctgcaaaagtttctcagtcaccacttatatttcatgactttgacccttgtgaaaataccagtcagatatcttgtggaatgtcccacaatgtgtatttgtctgatggtttctcataattagactagaaacaatgtgtaaattaaacatatttttccaaattagaaaacaagaaaaacagaataacatattagttagaagtattaacatagggctggacgcagtggcttatgcctataatcccaacactttgggaggtgaaggtgggcagattaattgaatccagcaattcagcaattcaagaccaatctgggcaacatggcagaacgctgtttctaaaaaaaatgcaaaaaattagctaggtgttgcagcatatgtctgcagtctcagctactcgggaggctgaggtgggaggattgggagggtggcctgagcttgggaggtcaaggttcactgagctgtgattgtgccatagcgctccaacctgggcaagagagtgagaccatatctcaacaaaaaagagagaaaagaaaaaataacagagaaaaataatttttaaaaatcaggtaatgacaaatagggaattccaaatatattgctaatggtctgttaagcttgacagtgcttttagaaaacttgttctgtttagaatagtgttagactcacagaacaaattggtaatataaagagtttacatataccacacacagttttccttattataaatcttaacattagtgtgttacgcttgttacaattaagaaccaatgttaaacattatcattcactgctatccatgctttattcacatgtccttaatttcacttaatgtccattttttgattctggaatcccatccaggatgacacatcatatttagatgtcattcctctttatgcttcataagctgttgacacttccttcaactttcctggtctttcatgacattgacatacttcattaggaagttgtctgattttttttttttttgagatgactctcgttctgttgcccaggctggagtgcagtgacgcgatctcggcttgctgcaagctccgcctcccaggttcacgccattctcctgcctcagtctcccaagtagctgggactacaggcgcccgccaccacgcccagctaatttttcgtatttttagtggagacggggtttcaccgtgttagccaggctggtctcaatctcctgacctcgtgatctgcccacctcggcctcccaaagtgctgggattacaggcgtgagccaccgtgcccagccataggttttcaaaaggaggactacacagggaaattgccattcttatcacatcataccaatgttacatactaatagcatgtcatatcatgttgaccttaatttgattacctatttgaattacttcttatcagattcttccactgttaaattgctatttgttacacttcctgtgttgtacttttgaaaagaagtcattaggcttagtaagaagtgggaagtcattcttcacctctttatgggaagagtatctgcaaaaataatttggaatccttcaacatgtgaaatgtgtcagttttcctccatttgttttatatattttttcactcatttatttatatcaatatgcaaacatggatctttattttacacttacattttactagtttattttgttgttcaaaattttctactcttggctattggaaggtcttttaattggctactatatcattttcgtatacacactcctagtataatggcatgaatccgtttatgaggctaaagccctcaaggcctaattaccttttaacagccccaccttttaatactgctacagtggcagttagtttccactaactgtaggggacaaaaattcaaaccatagcaagaacataccaaaaccatttttaaaaacaataatgcatttatttctgcaaaaaatggccataaagggccacctttatatgtgatcatgtagatcaccctctatatgataaggaagacaaatggagaacgaattagatagagaactgttgtgaattaaagtattaggtttggaatacaactttttgggttgattgctcatatttcttagaacagaaattctcagtgtacaactttaactctgaagaaagctacccatccaatgaagaagtagcaaagtgactgtttgccatttctatcttccttctcaatagatttattgaaacatagcatatacatcacctctccacatttgttgtacttttgttatttctagttcattcttgaggtttctctttaacacagcgactattaattctagcccagttggccaggagctgtggctcacacctgtaatcccagcacttgaggttgaggtgggtggaatgcttgagctcaggagttcaagacctttgggcaacatggtgaaaccccatctctactaaaaacacaaatttagctgggtgtggtgatgggcacctgcagtcccatcaccatactcgggaggctgaggcaggagaatcacttgaacttgggaagcagaggttgcagcgagccgagattgtgccactgcactccagcctgggtgacagagcgagactccgtctcaaaaaaaaaaaaaaaattctagtgctgctcaagaagcctctagaagatttgttcatggatgtttacattgtgcctttcagggtacacttttttaaatcttattttacagccaaatacataattatctgatttgtcagtggttttattctccattgtgaaatgtaaagtaatgatgcaacctataattgatgtgaataatttattttgcaattactatttatgtcagtatcagcaaatactacattcatttgtatagatgatattaatctacaggttttatggattattagttcatttcatcctcacagcatctcaagaggtcggcactagttttactcccaatcacctagtgaatttgatctaaagccctacaagaaaggaatggatgaaacttgattttgactgagtctatctttgaagtctttacttacatcacgtgttttagaatatctttttttgtatggaaaacacattctaggaccggattaagaaatgttactctagggccaggcgcagtggctcatgcctgtaataccagcattttgggaggttgaggcaggcagatcacgtgaggtcagaagtttgagaccagcctggccaatgtggcaaaataccgtctctactaaaaatacaaaaaaattatccaggcatgctggcgggcacctgtaatcccagctactcaggaagctgaggcaggagaattgcttgaactcaggaggaggaggttgcagtgagccaagattgcaccattgcactccagcctgggcaacagagcgagaatctgtctcaaaaaaaaaaaaaaaaaaaaaaaggtattctaccccggaagtcatgttcccaaattagatgtaaatcctgtgttaaattgatttaatatttaggtctaagatccacctaggaatgattttatgtgtaatgtgaggttatagatcagattttatttttccctgtggatatatttcttgaaatatttatagaaaaattcacatttccccaattaatcttataaattatttgtgtatatatgcttgtgtctgatttgctctctcctttttttttccattggtttatttctctgtgaaaatatcacactattttagtaagacacttcatttaacacagaattttctctctagggccttctcttagccaagtgtgctattatataaagaagaaagagtgaaaacctctatgccttgaacctacaccaatattctcagttgtcccttgaataaagagcagaatttagaactcactattactgatgacacttaggtctttaatgttcttgtgaatcttagacaacccccacaacatcattccctgctttatttgcttagtccattcttggtggattttatgagatgtcaacactcctcattaggattccctccttctgaagcctttgggattttctacccacccagcaaccaccagaggtggcagaaacccctgcagacatccttcttgcgcaagcgcagttgtaccatgaatgcggtcgtcctgctgcagaccacgcccaccaagggcggggccacatccactgcagctgagctcagagccttctgtggggtctgcagtggcaaggccagccgccccctgtcttccctctggagctgtttgaggaatgcagttcttttgcataagaaaggcttttctctccagtcattctgcttgctgatcaagaacacttaacagcttcaggctttcctggtaatattcattcttgcttttgtgtttttgttttaaggtccaaatatctttaatacttgtatgcagttttcttttttataatttcacataaacatcatctaaaaccaacttcgcatgttcgcattctgtattaacaactttcgtttttgtatttaaaaatacattcataatcactttttcaaaatatcttgtcagttattttcatcttttccatgatcattctttaccagtgcaatggaaatattacttttattaggaaaagcagatgtcacgcggtttttagtgttgtcgagaaatttcctatgaaacatctctggttgaaaaggagaggaacaaaattttatgtgaggcacaagatcacatatgctcagaatcgcatgctttaataaaggctgtgattatttgcattatattgtttagcttgttctaattgtaaaaggtagacaaagaattaatttgtgtagacagaacattgcgactcccattctaaatgtagagacagtcactgcactgcgcaaataggaatgtcgtcatgttgtttgcttttctccttaccccaaaactgtagacattggctagagtctttgatttttttcccaacttgcttttgtaattgtcggcatgatgtttgcacagataaccaatgatatagatatatatttttttcttactatttgatgaatgattaatattttgggttttttttatgttttcagtgaatcaaaaatatcattcagaaaatgttgtcatccatatccaggtagcatatagttttataatctgatcttgtaataaggaaattacagtccttattgattttctgttattagttagcattttttaagttttcatgcttgtgagtatttgggaattttttttttactctgtcaataatttaacacctttgtattggtcatctgggtcgatgtctattgtttaggctcaacctttgacactcctctgaggtagtttttatgtgaatttgtaaccacccaagggattcaccttgccagctgtctagacagagccgatttatcaagacaagggaactataatagagaagcaagaattcacccagagccggctgtgcaggagaccatagttttattattactcaaatcaatctccctgtagggggatcaggggtttctaagaataatttggtgggtagggggtcggaaagtggggagtgctgattggtcatgttggagatgaaatcatagggagtggaagctgtcctcttgcgctgagtcagttccccggttggggccataagatcagatgagtcagtttattgatctgggtggtatcagctgatccatcgggagcagggcctgcaatagatctcaagcactgactgagcttaggtttcacaatagtgatgttatccccaggagcagtttgaggcagtttagagtcctgcagtctccagctggatgaatcctaaaccgtaatttttaatcttgtagctgatttgttattcctacaaaggcatgatggaggggggttgttttgggaaagggctgttactgtcttcatttaaaagctaaactataaaccgaattcctcctgaagttcgcggggaatgaacaagggcagcttggaggttagaagcaagatggagtcagttaggtcagatctctttcactgtaataattttctcagttatgattttttgcaaagatggtttcaaattgatggcttagtgtcctgggtagtgaaaatggaattcctcaacctgaattgaacatggatttcctcctgaagaaacaatttagggctccaaaaagtaaaccaggagcctggcacagtggtcacacctgtaatcccagcactttgggaggctaaggcgggtggatcataaggccaggagtttgatactagcctggacaacatggtgaaaccctgtctacttaaaaaaaaaaaatacaaaaattagccgggcatgctgatatgcacctgtaatcccagctactcgggaggctgaggcaggagaattgcttgaacttgggaggctgaggttgcagtgagtcaacatcgagccactgcactccagtctgggtgacagagaaagactctgtggggtatgatgaggcttctcttcaaatagcctgatcaatcgtttattctttaattaatagtaacccccacccccttttcctttttctcttttttctttctgcctttgttgcatgcccggacatgccacagtagcaggcttatcagtaccagctcacattcctttccttatttggaaaggagactagctctctagctcattgcagacaccccttccccttttcccctctctcccttatgtgcccaccttatctaaagaaagttcaattgtctagccaaccaggattagttcagactgtgcgacctgacctccaccaatgggaaaagggtacaggggcaggacttggggcaggaataaagactcttgtgcccctttgttctggtgtgctttcatggcgactggccaaggagaagcacccctctgcgcagaagtaaaattgctttgctaagaatcctttgtttgagtgttcaatctcccttaggattttgagcattattcccaaccattcaatccaaaaaaaaaagtagaccaggattgatttagggcctgtattataaattgtacaaatgccaacaagattgtattccactagaggaacgcattctctagtgaaggaagcattcctgcaggatgagtccctgagactcactagcaaatttcatacaagtaatgaaatcctcagtctaatggaataaaaacaattccaggggcatttgttaaagatgtataagatgtgagaaaccaacagactaacagcattgatactttatggatatttttattccaaattaatagatgtgttacaggaaaagggtcctgatccagaccccaagagagggttgccgatattcagggccagtctgcagagtaaagtgaaagcaagcttactaagaaagtaaagcagaaaaagaatggttactccatagacagagcagccctgtgggctgctggattcccattttcatggttatttattgattatatgctaaaccaagggtggattatccatgcctcccctttttagaccatataaagtaactttctgatgttgccatggcatttgtaaactgtcgtggtgctggagggatgtagcactgaggacgaccagaggtcactctcgtcaccatcatggttttggtggattttagccggcctctttactgcagcctgttttatcagcaagatctttatgacctgtatcttgtgccagtctcctgatgtgacttaaaatgccttaaccatctgggaatgcagcccagtaggtctcatcctcattttacccagccctattcaagatggagttgctctggttcacatgcctctgacagatggacatttgtttgccaagcaatgctgcaatcaggggctctggatttcagtcctccatacagagaatgtcaagggcagaccttaataaaaataaataaatgaataatcaaatttttaaaattacctctttcattcttttattgtattatgatctgacaccattaactttaattttcttgcatatggagagcaacttgatacaaactggtatttatttagtgaagaaaagagataaggtgattcccaaatttaaaggaaactggaagttttgtgggaaacaaatggaggagataagacttactagtttctacttattttaatgagaattgtgttgttcatttataaatacaaagctccatttaaattacagatgcttttgatttatgatgaggttacttccagataaacccatcacaagttaaaaatgtcatcagtcgaaaatgcattgaatatacctaacttagttaaaatcacagcctagcctatcatccttaagtgtgctcaaaacacttatattagcctaacgtttgggaagatcatccacacaaagcctattttatcataaagtgttgaatatctcatgcaatttattgaatactgtactgaaacagaaaaacagaaagattggacactcaaagtatagtttccattaatgtgtattgcttttatttaatttaaaaattttaagttgaatcatagcaagtgaggaagcccatatattataaaatgtaataagtttaccagccacaaataacaacaaatcataggaaatgcagggattgggttgaggtgaggtggttcaacctattatacccatttccttcatctctaatgggctgcccttcatccttggggttgttgcagggtggctgtgcagtgcaaagggcacacaagaattgcttgaacctgggaggtggaggttgcattgagctgagattgtgccactgcactctagcctgggcaacagagtgagaccccatctcaaaagcataaataaataaaaggataatatctctgtcaaagtacagtgatgcattgcttaatcatggaaataccttctgagaaatgcattgtttggtgatttcatctctgtgcaaacatggagagcattacacaaacctagaaggcatagcctactacacatccaggctacatggtacttactattgctcccaagctataagcctataagcatgtgactgtcctgaatactataagcaattgtaacacaatgataagtatttaaacatgtaacctatctaaacatagaaaacataaaaagatggtataaaacaaaaaatattgttcagttgtatagggcagttgccatgcctggagcttgcaggactggaagttcttctgggtgagtcagtgagtgagtggtgagtgaatgtgaagacctaggacattactgtatgctactgcagactttagaaacactgtaaactaaggctacacttaatttattaaaaactaaagtaattgtgctatggcatcgtgacagctttgacatctctaggtgataggaagttctcaggtcaattataaccttatgagagtaccctcctatatgttgtctttccttgacagaataaaatatcattttgagagccatgactaataaacacataagagtcgatttaatatttattttaaaagcccttccatagttataaaagcataagttttagtcacatcaaaatataaacaatcttgaaattaattcataagtaaatcaatagatatcttgaaattgtgcttatgatagttctaaaccagactttaatgcagaatcttggatatcttaatcgcactgtgtggcaggaagactgatggcaataaaacatttcttaaaaaagaggctgcagcattttctgtgcaatttgcaccattcctgttcacacctgttctgtaagtgttgctgcaggcgatcctgtaagaaatgacagcgggttgcagcgcaagttcatgcaaacaatgaaaagcatgtcatggctaccactaggctaacgctattgtaataaaatttgaaataaaatagactagaaatgatgaaatatgagaacaacattggaaatatttatcaagggaaccatattaatgtaagcgaattttagagaacaaaatacttttcctaggtctgcaaggacaaaactgtccagaagaacagaagagggacagatgaggtagaagcagcatggcccatgagaggggctctgcagtggattgagggtggggaggctggcaaaaaggctgggcagaatcagggctcacatcctgacctgagaacagaagagagcacaagaaacaggttcatcttcaggcacaaatcctcttcagattgaaagagagatggagtgtctagggaagtaggcaagcatttggggaaggagagtcactgattcattagtgaaacacaacaaaaaaacaaaatcttctgtgttgctgtttgtccactgcatgtgtggggctcacaggggaacaacatagacaaagtttccaaattctcaggtgtttaagacgagtgaggattcagaaaacttaacagaaactaaactgcaagtgcaagagctgcccttaggaactcaggggacaggcatcaggcctgggatgggatggacaaggggggccttcaggaggaggagcattggaggagatgctgaagagtgaggggcaggggatccaccagacaggggaggtaaagggaagaggaaacagtgtgtctggcacagttcagggcatgagataagggcagtgggttggaaggatcgctgggatgaataatatatgaggaggcaggagcaggaaggacagaccataaagggcctgagcaggggagggaggacagctctggaagtgatgcagaggctgctccctgcggactgccttctgtggggaggagttcgaatgccttttcttcttttaagtgttactcacaatccatgagatctactgacaaggaagacagttggaacaagtaagaatagtccttgtttgatgggaaggagcagtagcattaccaggaggggttggtgttggggaggggcaagggtggggaagggcagagaagtttctgtcccctcagccattttgcagatgtaggttggatcactggatcacaaattcacagtggctggctcatggccaccttgcatcacagggtgagagcagcctcacaggaaactgcagataaggggggttcccagctgcacagaagaaggacagcaggtaactttcagtcaaggttggcagggggctgcagaggtggcagcaatgatggtggtgggcagtgtgcagccttgtaggccactgtctccatggacatacagatttgcacgcatctgtgtctgcgtgtcctctcggtgtgctgacattcttacaaaatcctcatgaatttctcattgttctgagaccataacatgtattttgacttttttctaccacatgtaccctttcatgtgtacctagcaaaattgaccaaaattccttattggtggattattcatagctacagtattttccaacttaataactaaatgaattgccctgctttgtatatgtttgcctaatcattcctgaagattcatgtctcctcatttcagggggagccacccctgcatgttcataagcaggagttcagtttagggtgttctgttttcctagttaactgtggacacatctgcgttctggaaactattaaactctcaatactcatttgaaaattccagttactttatcttttacttagctttcactttatttacagtactctctcttttctcctgcttactttggatttcgtttgctctacttttaagtttcctatggaggaaatttagattatcgatttttagatgttttttcttttttaaattttatttatttatttatttttattttattattatttttttttttggagagggagtctctctctgtcgcccaggctggagtgccatggcgtgaactctgcttactgcaagctccgcctcccgggttcacactattctcctgcctcagcctcccaagtagctgggactacaggcgcccaccacaacgcccggctaattttttttgtatttttagtagagacggggtttcaccatgttagccaggatggtctcgatctcctgaccttgtgatccgcccgcctcggcctcccaaagtgctaggattacaggcaagaaccgccgctcccggcccctcttcttttctttttttttttttttttttttttggtggaattttgcttttgtcacacaggctagaatacaatggcgcaatctcggctcgctgcaacctctgcctcccgggttcaagcgattctcctgccttagcctccctagtagctgggattacaggcgcccgccaccacgcccagctaatttttgtatttttagtagaaacggggtttcgccatgttggtcaggctggtctccaactcctgacctcaggtaatctgcccacctcagcctcccaaagttctgggattacaggtgtgagccactgtgcctggccaatgtttttttttgtttgtttgctttgtttttaatagatacatttcccccctatgctccctcactgcattctacaaattttgataagatgcattttaatttaaacttagttcaaaatgttgtttaattttctcttgagatttcttgcatcatgtgttatttaaaagtgtgttagttaatctccatgtattttgaagtttaccagttatgtgccttttattgatttctatcttaattttattggggttttagggtatatatttgttaacataaaaatcatgagatctataaatttggaaagaaaaagagctataaatattcttgaaggtagccctacagcatgtatactgaacaaacatgcacgtaacctatgacccatgttcaccttggtgtggagactgagcttttttttttttttttttgagacagagtcttactctgtcccccaggctggagtgccatggtaccatcgtggctcactgcaacctctgcctcccaggttcaagcgattcacctgcctcagcctcccaaataactgggattacgggcacctgccaccatgtccagctaatttttgtatttttagtagagacagggtttcaccatgttggccaggctggtcttgaactcctgacctcaggtaatccacccgccttggcctcccaaagtgctatgattacaggtgtgagccaccacgcccagctgagacttaacatttaaatgtattacagttaggccctacacacaaaagcccctttcaggacacaaaggcagacaagtacacaatctctagaaaccagtcagacccagtccatgtttggtgggctcttatcaggagaaagttactgaaatcagtctcttgtgcaatcaaggctgtagcgatggctgttggaacagaggctggagttagcgtctggcggtggatgagctgcaaattgttttaagattgtttatgtggaagtcagtgcttgcttagctgctagagaaaaagataaacctcctgtcagttagaacatagtttattcttcaactataggggtgagtgacttaacccttgcctgtcatggccttaggtcttatttataatttgatatcttattgccaccaagaagagttcattccttcattcttatgatctctattttaatatgaatgctggtcagttgttgtgtctaaactgcaaaagagacagatgataacgaggcatgtcccacttcctgtcccatcatgactggaaactcagtttgtatggtttccctgcggtcctgtctgttcagtcagttggggggcttaggattttatttttaattctcatagaggagtgttgaagtcaccgaccgtaatagtggattcatctatttttcctgttttaacggtttctgcctcgtagttttatgttctgttgctacatgttagaattattatatcttcttggaaaattgaccccactattattatgtaatgcctttctatttccctgataatttttctgactgtatagtcagctttttctgaaattaatatagctactcctgctttttctatttgcttgctatattttgttccatctatttactttcagttaatatgtctccatttttattaaataacagataaaatgagatgtatgtactatgtataacatgaggtttgaataataatgtgcattgtggaatggctaaatccagctaattaacatgtgtattacctcacatagttatcatttttgtggagagaacactttctatccactttttaagcatttttttaaatagacacaggctctcgctctgcacctaggctggagtgcagtggtttgatcacagctcactgcagtgtagacctcctgagctcaagcaatcctcctgcctcagcttcctgagtagctgggactacaggtgcacaccaccatgcccagctaatctttagcgttttaaaaataagacttatgtttttaactagagaaaccatatggtacaatagatctcttgaaattattcctcctctctgactgaaattttgtatccatccacaaaacttctgcccaaccccaccctcaaccccaggctctggtaactaccgttctacatccccacttgtatgaaatcacattttttagatttcacatgagtaagatcttgaggtatttatctttgtatgcttaacatttcagttaacataatgtactccaggttcaaccatgttgtcgcaaatgacaggatttcctttttatatgcctcagtagtattccattggggattatatatataattttctttatctgtcaacggacacataggttgattccgtatgtttgctattgtgaacaatgttaaacacttctcattgaggagtgttgaagtcaccaactataatagtggattcatctatttttcctgttttaacaatttctgcctcatagtggtttgaacactgctaaaatatacatgagtgtaggtatctcttcaacatactgatttcattttctttggatatatagccagcgttgggattgctagatcttatggtagttctatttttaattttttgaggggcctctatacttttttcgataatggctgtaccgattaacattctcatcaacagtgtgcaggggtttcctttacaacacctgttatctttactctttttaataatagccttgtaacaggtataatatctcattttgattttaatttacatttccctgtatctgtctttatatttaaataagttttttttttttgggggggacggagtctcactctgtcgcccaggctggagtgcagtggtgtgatctcggctcactgcaagctccgcctccctggttcacgccattctcctgcctcagcctcccgagtagctgggactacaggcgcccgccaccacgctcagctaattttttgtatttttagtagagacagggtttcaccatgttagccaggatggtcccgatctcctgacctcatgatccacccgcctcggcctcccaaagtgctgggattacaggcgtgagccactgcgcccggccttaaataagttttctctagagaacatatggttaagtcttgttttttgatccactccaacagtctgtgtcttttcattggtggttttgagccattgaaagtcaatgtgattattgataatagcagattgctatctaccatgtttatttctgcttttcatttgctgcccttgttctttgttcctcctcctgtcttccatttgtttgcttccctttatggttttaattgagaatttcatatgatccaattttctcttcttagcatatcattatattttctttttatttttaaatattttagtagttgccatatgaaataaaaactttttcatattttagttgatataacagataacagtttgttaaaaacaaaaattgtagccatttatttgatgaggtattcttatgtttatagtttgagtgtgtgtgcatgtatatgggtgtgtgtgtgtatatatatatatatacacacacacatatacatatgcatgaatgctcatatataaatgcaatgaatgacagcaatagtacaaattaccaaagtacaaatgactattgtttccttattataggcaactcacactacttgtgaactgatagagtgttatttgaaagggagtttgaattaactgtaaatttagggactggctattggattaagatcctccattccttggctggctgttgtccagaggctgcattcagctccttcccatgttggcttctcccacatggcagaatgctccatcaaagctacaaggggagagtttgctagcaagacagaagtaatgattttacatagcataattacccatgtgatgtaccttcagctgtgctctattctcttgtttcaaaataagtcaaggttgctgcccacacttacagggagaggattagaatgcaaggttgtgttcaccagcaggtgggaatcactgggtgccaatctagggtctgcttgctgtgtcagatcttctccaacctgcaacagtttctcagtgttcaattattttgtataacctgaattcttttgaaaagtaccagtcaggtgttttgtggaatttcctacaaaatggattagtctcatgggtctcattattacaatagagatatgcattaatttagacacatgtatgtgggtgttaagaaaaactgaacaatgtattacttagaaatacaaaaggagagaccaggtgcaatagctcacaccggtaatcccagcactttgggaggacgaggtgggaggatcacttgaggccaggagttccagactagcctaggcaacatagccagaccctatctctaaccacaacaacaaaaatttaaaattagccaggcatggtggtgcacacctgtggtccaagctactagggaggctgaggcagcaggatgtcttgagcccgggaggtcgaggctaaagtgagccatgatcacaccacagcgctccagcctgagctacagagtgataccgtgtctcaaaaaaaatggggatatgcactcaggggttttcaacaatattgacaaggtttggcttattatactgggaagggaatttataaaaaagaaacttgttaaattttagaatagtttagatatacacagcagttgccaagataatacagatcatttccttatgcttagcatatagtttcccttattattaatcccttacattagtgggtgatatttgtcacaattcataattcagtagtatacattatccttctctatgattcacattttatttagaatttttcttctaccgaatgaacactttgtgttccaggattccctccaggagaccacatcacatttagaaatcccatctcattaggttccttctgcctgtgacagtttctcagactttccttgttattgatgacattaacatccccaatttgggatttctctgacatttttctcatgattatactggagttgggtttggggaaggaagatcactgagagaaaatgtcattgtaaccacatcatatcacgggtgtctactatcaacatgattcatgcctgttgatagcaatttgattacctggacaagttagcctttgtcaaatttctttactgtaaaattatttctttctccactttccctgtttcactttttgaaaataagtcagcatacatagcacatacttaagaacaagaaagttatgctctacctccttatgaactgaggacctaaaacaagagttgagaactctttactgtatacagttggcctgttctccaccatgatttcataccatttatttatactgtattgaatatgatatgaaattagatatattcagttcacatctcccttatactcctttatttcatagctcgaattgttccattgttggccattggaaggtctctcagttggctcccatatcattttgaaatagccacattattttggttagattttgcttgtttggtggttcaattgtaatgtttcatagtttcttactttcaggcactacagggtcctccaggccaattgtgtttatttcgtgcccaagcctggtacccatcatttcttcaagggtcctagtttcttttattggaaaatggcttttaaaacaaagatacagacccaggtatattcactgatactgggtcatctgtcgatttgaggagtagtcagctgacaaaacaatgaaacgtacctgtgtatactaacccacacatatacacatatgtgtaaatatttcctcatatgttcatatataacctgattaacttaaacataaattcctactaatgtctccagcactacatgaatataatataacttgaatcaatctccccattcccactacttggttgtaacccccactctaacagtgagtgagttggccttgttaacttaatcaccaagttagaggctacatgcatagtggcttcagaattgttcatccacactctcatgaagaacaacattaccaactaaagtacagtgctcatagacaacttcttggacctttagatgcagaatcttcactttgtacccaagttacttaggtcagttctttcccccgcctcccagcttcctttagtgaggttatatcatacatttcttattcatttttcttattttctctgtattcctctatgggatccctcaacctacaaataattattttctctgtattcctctatgggatccctcaacctacaaataattttttttttttggttttttgtttgtttgtttctttgttttttgagatagagtctcactctgtcacccagcctggagtgcaatggtgtgttcttggctcactgcagcctccgcctcccaggttccagcaattatcttgcttcagcttcccaggtagctgagattacaggcacgcaccaccacgcccggctaattatttggtatttttagcagagatggggtttcactatgttggccaagctggtctcaaatacctgacctcaggtaatccacccacctcggtctcccaagtctcccaagtgctaggattacaggcgtgagccaccatgcctggcttacaaataatatttttaatttccgtacatttaggttcactgtttgtattataaagttatgcagggtttcaaaaacaatatgatgtagcgaccatgcaggaagtttttattaccctaaagaaattccatctacttcacctatttcactgtcctccttggagagtccctagttagcattaatctgtttactatctctattattttacctttcccagggtgtcatatacatggaattgcacagtctgtcatcttttcaaactggcttccttaacttaaaaatatgcctttaattttatgaagtatatcttacggtgatttagatttgcattgctgaaggactaatgatgtcaatcatctttttatgtgccctttggggatacatattctttgaagaaatgtctatttatacaatttacccatttttagttggtatttgtcttttattttttgagatgtgacaatcttttatatattctgaacagtagaccctcattacctatatgactagcaaatattttgtctcttttttttttgagacaaagtctcgctctgttgcccaggctagagtgcagtggtgcaatcttggctcactgcaagctccgcctccccggttcacaccattctcctgcctcagcctcccaagcagctgggactacaggcgcccaccaccacgcctggctaatttttttgtacttttagcagagacggggtttcaccatgttagccaggatggtctcgatctcctgacttcatgattcgcccacctcagcctcccaaagtgctaggattacaggcgtaagccaccacgcccggccttttgtcctctttttagggttgttttatacttcttgatagtatatgttgaatgacaaacattttaaaaaatagatgaatttatctatttttgcttctgttacttgtgttttttgtgttatatcttagaaaccattaatttcagaccatgaagatacatttttaaaataactttttttttgagacatgagtatcacttttgttgcccaggttggagtgcagtggcacaatctcagctcactgcaacctctgcctcctgggttcaagtgattctcctgcctcagcctcccaagaggctaggattacaggtgcctgccaccacactaggctaattttgtatttttagtagagacagggtttcaccattttggccaggctggtctcaaactcctgacctcagatgatccacccacctaccatacccagtcaaaaatacatttttttttggaaaatatagtttaggctgggcgcagtggctcacgcctgtaatcccagcactgtgggaggccaaggcgggcggatcacctgaggttgggagttcgagaccagcctgaccaacatggagaaaccccgtctctactaacaataaaaaaattagctgagtgtgatgaaacatgcctgtaatcccacctacttggcaggctgagacagcagaatcgcttgaacctgggaagcagaggttgtggtgagctgagatcccaccattacactccagcctgggcaataagagtgaaactccgtctcgaaaaaaaaaaaaaaaaaaaaagctgggtgcggtggcttacgcctgtaatcccagcactttgtgaggctgaggcgggcggatcacactgcactccagcctgggtgacagagcgagactccgtctcaaaaaaaaaaaaaaaaaaaaaaaaatagttttcctcattgaattgccttggcaacttttgcaatccatagaccataaatgtcagggttaatctttggacagtcacttatattccattgacctatatcactgtccttatgccagtaccacaatgtcctcattactatcactttatattgtttagaaatcccataatccaactttgttctgcttctcattaccagtgtggttcttttagatctcatgaatttccatatgaattttagaatcagcttaccaattactcccgccttgcccgcaaaaaaaaagcaacagggattcccatagcacaacgacatcactctgctggacagcaagagggtgtgttcaggaaccatacctagtctacaaagccatgggactacataccacagtcccagggacaaccacaaaatcaagactcttcttttgtttttgtttcttttttttttttttgaaacggagtattgctcagtcacccaggctggagtgcaatggcacgatcccgactcactgcaacctctgcctcctgggttcaagcaattctcctgcaaatattttgtctctctttttttttgagacaaagtctcgctctgttgcccaggctagagtgcagtggtgcaatcttggctcactgcaagctccgcctccccggttcacaccattctcctgcctcagcctcccaagcagctgggaccacaagtgcccaccaccacgcctgcctaattttttgtatttttagtagagacggggtttcaccgtgttagccaggatggtctcgatctcctgacctcgtgatccacctgcctcggcctctcaaagtgctgggattacagacgtgagccaccgtgcctggccaactcttctttttatggtctgaaatcacggagtatattctctacatctcattcctaccttcaatgaggaaattagttcctgggatctgatgacctggagtgagagatgcagctgatctagaccacatttctcacttctgagatcagaatagcaaatatgtatgtactagtaatttggacatttgcaattcaagaaacctcgcacctcccacagcatacttcattcactccatgagaaaaaaacaaactcacttaaatattcatcttcagaaaaaaaaaaaaaaggctgcccgctgcggtggctcacgcctgtaatccactttgggaggccaaggctggcagatcacgaggtcaggaaatcgagattatcctggctaacacagtgaaacctcgtctctactaaaaatacaaaaaattagccgggcgtggtggcaggcgcctgtagtcccagctacttgggaggctgaggcaggagaatggcatgaacccgggaggtggagcttgcagtgagccaagatcgcaccactgcactccagcctgggtgacagagtgagactctgtctcaaaaaaaaaaaaaaaaaaaaaaaaggcagagtggcagaccaaaaacgagccatatgtcaatctggagtaggagtgaccaatgtcagagtggaaaatgagggctgatgagctttggttctcaggctttagagtaaaggtggtagatgcaaaactgtctatccaccgtgggtttatactgataagtgggcagtaaatgaaagaatagtgtaatcagctgatgttagagtgcaccttttaacaacgttcaagtacagatgcatcttaaaattgacattgtaaaaacaaagtttgccagaatctagtcataatatggctgtccttgtctgcacatgcatgaacttgatctgaaaacctttgattgacgtcttctggtgatatgatcaccatcaaaacttacagagatgctgtcagtaggttgaataatctcataaataggagagtaggactctgtcaagaaatgtgatgtcaccaaagttcctgattagcaaagatgatgacaatgtggggtaaatcatggacagggtgtgttgaaggtgattcagaagagtttgatctgagtgacaggaattttaggaatgctgttgttagtgtattctgcttatattttccatctttgtcatcatagaagtgatataagactaatacctgcatttatagtagttgaaagtttttttcagtaataatataaaattgtaagtgataagatgtatttgtcctatagtctacgaatttattcctatattgtgacataaaataatgatgcattttacaattgactcaaataataactatttcaattccttagaaaacactgtatgagaaaatgctgacttcatgtttagtatagatgtgctattagtctacaggttttaagtattattagttcattcaattctcacaacatttcaagaggtaggcaatattaccactcccaagttccagttgtgaatctgagctaaagccttacaggaaaagagtagaaaaacctgagcttgactttgtctgtctccagaatctttgtttacatcaactatgttagaatatcttttctatgataaatacatcctaagtctagtttcagaaattgtgctttacacaatagtcatgaaattatttttctcaatttcaatctaaatgctacattaaatcgtttttaagttcaggtcaatgaaccatctggtgatcattttgtatgtaatgtgaggtcaaaggtgagatttttattccctcccccaccgcaacagaagaatattcaatttcctagaacattgatagaaaaatcaattttccccccattgaactttaatatgtatgtataagagttttccactgggcatggtagctcacacctgtaatcccagcaatttaagtggctgtggtgtgaggactgcttgagcccaggagtttgagaaaggcctaggcaacatagcaaaacactgtctctacagaaataaaaattttaggccgggtgcggtagttcatgcctgtaatcccagcactttgggaggctgaggcgggcagatcacctgaggtcaggtgttcgagaccagcctggccaacatagtgaaaccccatctctaccaaaaatacaaaaactagccagacatggtggcacatgcctgcagtcctagctactcgggaggctgaggcaggagaatcgcttgaacctggcaagtggaggttgcagtgagccgagactgtgccactgcactccagcttgggcagcagagtgatactttgtctcaaaaaaaaaagaaaaaaaacaaaaaaaataaaaattttaaaaataaggagtgttcaacactctttctacttgctaacacttatgcaggttcaaatcttgccttttaatatttgtttttaatttgtcttgcagactaatgtctttatcacttgtgtacattttttttcctttggccacataagtatcatctacaacccaaaatacatttctcctttatttaaagcacaagtcaagcagacgttcaacaaataggcaataaaaatcagattaaagatactgtaggtccaggagctgtggctcatgcctttaatctcaacactttgggaagctgagatggtggatcacctgaggtcaggagtttgagaccagcctggccaacatggtgaaacgtcttctctgctaaaaatacaaaaattagctgagtgtggtggcgtgcgcctgtaatccaagctactcaggaggccgaggcaggagaatcgcttgagcccaggaggcagaggttgcagtgagctgagattgctccactgcgctccagcctgggccacagagcgagactccatctcaaaaaaaaaaaaaaaaaagatgctgtagtaggaaatgtgcattactctgttgaaatccacaaaatgcatgagcatacaacccaaatttaagtggtaattgaaggtttcctcgaagaggcagtttgtgattgaatagatgaagaataagcagctgaaaaccatgtaaattagaactaataaataacaaaggatgattagtattgaggtagagaatgggaatgtatagaatgcaaaaaaaattgagacatcgcaaggagagcagcaatttcagtacacttgaaggaagctagaaatatataccagggctagatttttaagatatttaatgccgtgtcaatgtgttggtattttataattttctgtagttccagacattagctagggtgtgctcacttaggaacacagctgttgaaattgtaaaatgagaatttgggtctcatacatttgaagaaaaaaatatatggggtttaggttcagattctgtacagacaaaggaaaagtatgggtggggaaaatgtgagacagcctgaggtccaggaaaaatggccacagaaaattttcgtattttcagataaaatctactcttcaagttagacctccctacgaaagatgctagttcaataatgaattctccacctggaaaaggacatttcagctccaagtccaggttgctttcatgccttaaagtcaccttatttgtatttcagaagcacgtgctacactagctttagggaatgaagaaccatgtgctgacagtgccatctagcatcaacagaaacaggaaccaatggcaacctaaataagtacagaaaaaaaggtggggtccaggaaccaagaatgactgctgatttgagcaggatttttacaatttgttttaaaacttaaacataatgcatagatgctgtggaattaaaaaatgcaacctaggccgggcgcggtggctgacgcctgtaatcccagcactttgggaggccaaggccggcggatcacctgaggtcaggagttcaagaccagcctggccaatatggtgaaacatctctacaaaacacacacacacacacacacacacacacacacacaaacacactagccgggcgcagtggcgcgcgcctgtaatcccagctactcgggaggttggggcaggagaatcgcttgaacccgggaggaggatgttgtggtaagccaagatcgggccactgcctggcgacagagcgaaactccgtctaaaaaagaaaaaaaatgcaatctaataatgtccagcaacgatacagggaagcctggcccatgctcacttttccagtcacctgctcttaagtagtgcacgggttaaagaacgatgtgagtgctagtggctgattctttcacttacaaacatgcatgtacacgattgtgttaccatggacaaacacataaaatttgattgtaaaactagttgactcttaactgtgacacattaaatccttgagtaaatgagtgtgtgtttccatacatatattcagtaccactacagttcacaaaatgaacgggacttcttaggttaaagccttgttaagttattctttaaaacgctttccaatctgatagagagctctggcgtattcgctcaagtttccgtggcgggtctagggctcctgaagccccacgggtctcactgctacccacatggctattaccgcaaccaccgctgccacgcagcccgcaagaaatgtgccaccgttctgagcggccgacaaacccgcagtgcgctacgggaaggtcacctgacagttggggagaacggcagcccgcaggggccgatcttcggcgcgcctgcacagcgcaggcggaattggggcgccttttctccttccggtttccgtttccgtgcgccccgagggtctgttccgcttatggcgcccgccgggagtctccctttcttcgcaagcgttaacctgcgttttactcgtaaaaatttgctttctaggcttcgtataattgttctggtcttgcactttatgtgtgcattagccttgagtttgcttgttgttttcccatgaaaaattgtattgtatttctgtaacagcccctcctcttgttacataaacattgaccagtaattgtatatccttccctctcaatattaacaattttatcttttttgcgttctttgaaaaaaacgaaatccttttcaaaaatactgaacttgtcatttttaagaaatgagatactactttaatcatttctgtattgtccttaagattctttatatattctttattgtttatcttttccactaatatacctttaatatgagaggacttgtagaggcttcagggtcacactttcgaaacccagagttttagtatctccttatagaatatttgtaatttaagaaaaattatacaaggttgaattttcaaaaatatatttttaaaatatatttaaaaaagtatttttaaatatagtcctccggaatgcaaaaggacaatactactttcagctagtactttttaagtgattattttccgccacgtattcttttgaaattatgcatttaggccgggtgcggtggctcacgcctgtaatcctagcactttgggcggccgaggcaggcagattgcctgagctcgggggttcgagaccagcctgggcaacacggtgaaacctcgtctctactaaaatacaaaagaaattacccgggggtggtggtgttcgcctgtagtcctagctactcgggaggctgaggcaggagaattgcttgaacctgggaggcggtggttgcagtgagccgagatcccgccactgcactctagcctggaggacagagtgcgattctgtctctacaaaaaaaaaagaaagaaagaaattatacatttaattgaagctcagaaaatatatgtgtgatgttttctatgaaatgaaacattgtttagatgagaaaataaatgtaaaatgcatttgccttttcaaagcagcaattagtggcgaagtgtgaatacaaaaccagtcttctttctgcagagaccatgtctgtcacccttgtgctggaatgaacaacatcacatatttttttgtttgcatatggcctgagggtcaaattctgcccagcatgtttgctttcttttttaaataaatatttattggaacacagctatgctgttcatttttgtattgccgatagctgccttaatgctacaatggcagtagttgcaagagacagaatgacccataaaaccaaaattatatactctctagccttcctatcacccactgttctgtctggtgttggggcaattcagtctttggtatgctaatttggatgagattcacacttgggctgttggagaggagtgggtgaacctgttgagttaatcagcaactccaagaggtccatttcccaagcatctttccttccataacttcacagtaattttcgtttccttatgtctcctctggccaatatttttctacttctggggtaggcggtcagaggaaagagaaaaaaaggaaaatggtgaagttggacccactgtcttggacctatgacgactcctggcagagaaaggttttcccacttttcgtttttgttcttgtgaactccctgagcagccactgtcatgacaacatgatggtctgagaggtggagtagaagagattggagaaaagggcgacagagtgagaccttgcctctaaaagaggggggtggtggtggagggatgggaggaaagggggattcttcactcttgagttccgttttcaatcctcgaacttttcctggagcccgcagtctgcaccacagcctcacttctgggtttctgcctgtcttaaattcaggcctggggataagtgagtggtaaaaattaaaattcatcaccaatttagtagtacttcacagtccagtgttattccttcatttctgttactacttagtcctcaaacagctgttccatacattttatccaagttttatagctatattcagtaggagagacagggcagaaaatactttttctttcctgaaaatggaaccctaatgggagcctgatgaattttttaattgaagccaaaataaaaaaattaatatgtgctcataaattcatatttatactcataaaatatgacattcaacccaagttcttcattttaacacttacgcctttttttttgagacagagtcttgctctgttgtccaggctggagtggaatggcatgatcttggctcactgcaacctctgtcatcagcgttcaagcaattcttgtgcctcactaccgggtcttactacattgcccaggctggtctcgaacttctgggctcaagtgatcctcccgccttggcctcccgcagtgctgtgattacaggcataaacctctacaaattttaatctacaaaaaacaaaattatattcgctttacctgtgtgacatttgaataatgacggtccatgcaggctttacatttcacttttatgaactaaaaaaaaattgagcctccacagggcaagtcctctgctgtgcatggaagataggcaggtgttcaaagcatagaaaggtactgctgccccaggtaatgcagtcaagagggaattcaagcatatggaggtgattttcattgctatcaagagtgtggtttaaaaagtcacagtaagggctggatgtggtggctcatgcctgtaatctcagcactttgggacgccaaggcaggtggatcacctgaggtcaggagttcgagaccagcctggccaacatggtgaaaccttgtctctactaaaaatacaaaaaaaaaacaatgagctgggcatgggggtggacacctgtaatcccagctacttgggaggctgaggcaggagaattgcttgaacctgggaggcagaggttgcaatgtgctgagattgtgccattgcactccagcctgggcaacaagagcgaaactccgagagagagagagagagagagagagagagggagggagggagggagggagggagggagggagagagagagagagagagagagagagagagagagaaagtcacagtaaggcaccctagcagagtgaaacaaaaactaaaaaaaaatcgtgttccagcataggcctgagcatttaaaaatcgaagaaccgtggaaatattaacaattacataaagtgcatctagattttgaagtcatttcatgcaatattcatgagttctgggtttatcagttattcctcagctttatttggtgtatcagttttaggaatgtgtatgtataatcgtcaagtcttctatctgaaaggtaccagaacaaagcctggctttaggatcagatcctgggcaggcaaaagagcgctagaggcggaacaagatatccttcctatctgaagtggccatgggttttcaactgacagccttctcctcatccacttccaccttccccgatgctctcagaggtagactatgaaggcctctccctaaccactttctagctgcctcttcatatccttagtgtatcatttctccaagctgtaggtgtcctgctaattgattttgaatttttatgttcttctgtgtgcgaatgattaaatattaaatacaaaagtcggttcatttgtttgttttttccaggcttgtaatctctaactttcatttttgctacaaagcctttaaaaaaaaaattcagttactctagattcagattttaattaaaatttatttttgaaggtaaacatcttacataaaatttggctaaaagggaagaaaaaaaactacctaaagtttatgtggtcatcctacttgcaatattttagcaagcatgatttttatttaatgagtttcaaaaattttgacaatgaatactatcacagagactaagagtgtgtgatttcttccactttcatagcacagatgctcctcgacttacaatggggttatgtccccaataaacccatcataaattgaaagtatcttaagttggccaggcacggtggcttacgcctgtaattccagcactttgggaggctgaggcaggtggatcatgaggtcaggagttcgagaccagcctgaccaacatggttaaatcctgtctctactaaaaatacaaaaattagctgggcgtggtggtgcacatctgtaatcccagctactcaggaggctgaggagaagaatcgcttgaacccaggaggcagatgttgcagtgagccgagatcataccactgcactccagcttgggcgacagagcgagactccatctcaaaaaaaaaaatatatatatatatagtgagttgaaatgcatttaatatatctaatctattgaatatcattgattggcccagccttgagcacttaaatttgctcaaaacacttacattagcctacatttgggcaaaatcatcaaacacaaagtctattttataataaagtgttgaatatctcatgtaattcataaaatactggaagtgaaaaacaatggttgtgtgaattctcaaagttcagtttctactgaatgcttatcactgtcacaccatcataaagttgaaaaattgtaagttgaaccatcttaagttggggactatctgtactgtgaaattccaacttctggacagtcaagaaggaagccagtaaaatcagaaaccagcggctttgcagccaagtaagcagggaggccaagcgtattccttggatggtctgcggtgggcagtctctgccaggatgtgcccacttagcacacacagccctgtacatcagcctgcaggaaaggcaccttggccagagcctcgggctcaccctagagcactatagaaaggtcatctggctgtctgggaggacagtagcccacaggggctgaagctgggcacacccactgggtggctcagggccagttttataatccctaccccctcaacaaacacactccactcttgaccactgcactccaacctctgtccctgcatcctccaccaggctttacacctgcaattgcactttggataataacaggcatcattggcaatatcttacactctatcatttcagataaagccttgaaaaatatgtgcaattatatctgtgcttctttgtggatatatgttttattatattcactatatgattataataatattagttactactagtatttatcaagaatgtagggctgaagctgggcacagtggctcatgcctgtaattccagcattttgggaggctgaagcaggtgtatcacttgaggtcaggaatttgagactagcctggccaacatggtgaaacctgatctctactgaaaatacaaaaattaaccgggcatttatgcctgtagtctcagctactcgggaggctgaggcacgagaattgcttgagcctgggaggtggaggttgcagtgagctgagatcgtgtcactgcactccagctgggacaacagagccccactctgtctaaaaaaaaaaaaaaaaagaatgtagggctgggcatggtggctcacgcctgtaatcccagcattttgggaggctgaagcaggaagattgcttgagctcaggagttcaagaccagcctgggcaacatggcataaccctgcctctacaaaaaaaaaaaaaaaagatctatatacacacacacaaatgccaggcatggtgacacatgcctgtggtcccaactacttgaaaggttgaggtgggaggatcgcttgagcccagaaggtcaaggctgccgtgaggcatgatggatccacggcacttcagcctgggtgaaagagcgagaccctgtctcaaaacacaaacaaacaaaaagggtgtagtatattcctggtattgattgtgcttttcatagtttaaaagtaagacttggtgtaaaggtatgcattgtgtagtataaatgcacagagaggaaaggagagattgggtacaaattcaggaaggcatgaagtgttgatgtcatgacacttagcccatccttgctctgcacagaccacgtttctcaccactgtgctggtatgtagacaccagcatgatcttctgaagcctcggataatttggtgtggatagctttcttttggattcttttaaattttgttatcttaaagctttccatagtatttcatatggataggccacagttactttccatttactattatacttttatatattttttcttattttgatatgagaaacaatgttggaataatcatgcctagacataaataagccaatttcaaaatgtttgtaggggagactcatagtgttgccagaaaaaggggccctgacccagaccccaaaagagggttcttggatctctagcaggaaggaattcaaggcgagatgcagagtgcactgaaaagagagagtttattgaaagctactcagctatagagtagagcatcctcagaaagcaagaggagaaatgccttgtatttaagttttttttatgtaagtgtcttgtctatgtaaagactaaactaagctgtgtctacgtgcagatgggttgagagcatgacaaaatttactattctgttgatttaaagaaaatggtccttgacattttagtaagtacatcaaagccataactgtaagtaacttgaaagcatatattgttatgggtattgggacatctggattttgtgttgttgtaggagtgtatccttgcaccggtagcctaggtattgttaagctgtttcctcaattataaacatgactatgggttgtgaccagcaaggaatgtgccttagttaatctcaagatggagctgaacttaaaatgccattactttggctctaaccagctcctgcttccataacagtggggtcaaaaggtgttcctttaaaatcttcctagacactgccaaattgcttttggaaacttctcacctggtgagatggcatgagtatctttggctcatttttctacatagacttggaaacagttttatgtttataaaatatgtatcacctcatttataaatttgtttgaataatttaaccattttgcttttattagctattttgctactctctgttttccttgcctgagtctttcccacatctctgcaacattgtatcatttcccacacctaaaaccaaagagggacaggcaagccagtggagagagcagaggctgatgagaacgaaggattttccaggaaggaatctggggctgtgtgtgtgtgtgtgtgtgtgtgtgtgtgtgtgtgtatgtctgggtgtgtgaatattgtttttattagcctgtagcccacgtgttgcatggccatatttttactatcaggatataaaacacacttacacacagctgcatacaaatgcaatgagtttatttttcatatacatttcaaaataatagcgtgaacagaccagaactcttcttcaaagttcaagaatgtcctcatggatccagcatccgtctggtttctgtttctgcattctcagtacatagcctcacttctctttctccaattttggaggatgtgtaaaaaattttattcttaaccaaacattagtcaggctccggaacgttctcttaactccatccatgcactttcttgtaaaatgcagttttaacaagaacactgctaagttagtttagcaagacccccacaccttagacatctgatcaccttctatatcttatcaggttcctcatcctccaccatcccttaagtgatcatcccagcttgtcttcagcaagaatcctattagatcaatttagccagaatccctcttgcccctgatgttaattcttagtaattttccaaccactagtccccaccctgttccttggctataaattgccacttgcccatgctgtacttagagttacttagagttgagtctcactctctcccacactgcaaggccccattacggcggtccctaaatctattgcagtggtcccgaataaagtcttccttactatgcattaacacgtatcattgaatatgactttttctttaacagatactttgacgaaggtaattgggactcccatcaagtctccacacagctagcagccacgtggggcacttctccaggtaaggattgtccctgttccacttatgttcctgtcagtaaaatggtaggttcagtgtcaggctttaccattttcttcagggagagacccatctgatatttagtcagccatcagatgggtccagccatagcacacattagctgtgacatgacgtcgtttatgacaatgactttgagcagagttgcacacctaaaaagggactcaattaaaattatcattcattttagttatttctcagatgcatttattatttccattttccaaaactcctaatgttacatttcttcttcacatgttagatatgaacaaagtaagactaactgtggccacatcctctttacttaggaccctacccaaagtggcaggaatgggatgtaaagtgacataatcagacacagtcaaactggcttttaatcgttaagtatcattgtcatctcaaagcacttggcatagttactgaccccttaaatgtcctttctccatcttatcttctcctttgttctctgtatcatcttccggtcctatagaaatatatccccacgagcacacactgaggtctttttttttttttttttttgagacggagtcttgctctgttgcccagactggagtgcagtggcatgatctcagctcactgcaacctctgcctctcgagttcaagcgattctcctgcctcaggctcccatgtagctgggattacaggcatgcgccaccatgcctggctaatttttgtatttttagtagagacaaggtttcaccatgttggccaggctgctctcaaactcctgacctcaggttatcctccggcctcggcctcccaaagtgctgggattaccagcatgagccatcgcacctggcctcactgaggtcttaatgctgagttgaactttgtctctggccatgagcatcagtccatgtattataataggtttgggttgggtgtggtggctcacacctgtaatcccagcactttgggaggccgaggcaggctcacaggtaaacaatttagacaaagttttcacattctctgagatttgtatacattggagattcagaaaaatgtaaccgaaaattaaactataggtggaatagctgcctttgggggctgagaagacaggcatcagacctgggatagacaagggaggcctcttgttccttgaaatgataccccagcccatgaggtctgcatgccaggaagccaaatgagtgaggatggtctgtgtccgctggggaggtccctggatgttgccaagagggatagggtctgggaaagagtgaggatggagtcaggcagagaggaccccccaggctcatggatggactgacctgaggacttatattaagtcataggacagtagagaaagtaagagccaagcataatgtaatcctaacaatgtaaaaagtattaatcattttattattagttaatgtcactgaactgtacacttaaaatggctaaaaaggtaaattttaggttacatatattttaccgtaatataaaatgacaaatatattagaaatgacttttttttttttttgagatgtagtcttgctctgttgcccgggctagaatgcagtggcacaatctcggctcaccacaacctccgcctcccaggttcaagtgattctcctgcctcagcctcccaaatagctgggattacaggtgtccgccaccatgtccaactaatttttgtatttttagtagagacaggtttcactgtcttggccaggctggtctcgaactccagacctcgtgatccacccacctcgggttcccaaagtgctgagattacaggcgtgacccaccacgcctggccaggaatgactgtcaactatattttcttaacatatgtattcctacacaacatcagttttgtaatagtttatttttgttttgttttgcaatttttttcttttattgtaaggaaagaagtacattttttcagcgtgtaagaatgcaaaagtaattatcagatgtttgtcacatcttaacaaaataggaccttattttcctagatgttgctgcattcagtccctttcttggtatggtaaaagcatcaatcagccagggaggcaactataaatacagaagagcagtttcctacagatagtcaaccatgctacccctcttactgacttaattttaatattggagcctggcacaattaacctagtttcctcgtaaacacaagaacaacgtactgcaatcaatgtaggcatatacaggctcttaaagttctgagaagcagcaagtaagttcatcatttactaagatccttgacattcttctgtttctgtgaaatttatgcatctgtgagaagtttcttttctttttttatttttttttgagacagagtctcgctctgtcacccaggctggagtgctgtggcacaatcttggctcactgcaacctgaacctctggggttcatgccattctcttgcctcagcctcccgagtagctggaactacaggcacacgccaccacacctggctaatttttatatttttaatagagacagggtttcaccatgttggccaggctggtctcgaactcctgacctcaggtgatccacccaccttggccttccaaagtgctgggattacaggcgtgagccaccgtgcccagctgagaagtttcttatactagaagaaaaagaaaatttgatttattttaaaatataatggtttagtctgtagcaagtaatattaatttttttatttttttatttttgagacggagtctcattctgtcacccagactggagttcaatggcacgatctccgctcactgcaagctccgcctcccgggttcaggccattctcttgcctcagcctcctgagtagctgggactacaggcgcctgccaccacgcccagctaatttttttttgtatttttagtagagacagggtttcaccgtgttagccaggatggtcttgatctcctgacctcgtgattcacccgcctcggcctcccaaagtgctgggattacaggcatgagccaccgtgcccggccctaacacgaattcttaagagaggtgaaccagggatgggattgtggatcaatcatgcaaagaccgactcctctgggcttcatttcctccatactgaatgtgcatccctacatgttcatgttgttgtttcataggtagtgcagggggtcagaataggatacccctggctgggtgtggtggctcacgcctgtaatctcagcactttgggaggccaaggcaggtggatcacctcagatcaggagtttgaaaccagcctggccaacatggtgaaaccccttctctactaaaaatacaaaaattagccgggtgtggtggtacacgcttgtagtcccagctactcaggagactgaggcaggagaatggcttgaacccgagaggcagaggttgcagtgagctgagatcgcacctctgcactccagcctaggtgagattgaaactccatttcaaaaaaaaaaaaaaaaaaaggatatcctcaattgcggtgccctggcatactgagtattttaagctgaaggaaattgagaaaaccatggaagcaggaaggccactctctgatttgctcccacttttctcccctgaagcaggtcataaaagaattatctgccctacctgtcctgaaagtaggtcataatgggaccctcatttcagaggagttctgccctatccctggataccaacaaagatctgaacaaacaggtcttatgaatttctccccaggtaattactattagatgataccctttgttccccaaagctatttcttcaaaactgtccataaaaatacacctatccagctgggcacagtggctcacacctgtaatcccagtactttgggaggctgaggcgggtggatcacgaggtcaggagttcaagacaagcctgaccaacatggtgaaaccccacctctactaaaaatacaaaaaacaactagctgggtgtggtggcacaagcctgtagtcccagctactcaggaggctgaggcaggagaatcgcttgaacccaggaggtggaggttgcagtgagccgagatcgcgccattgcactccagcctgggcaacagagcgagactctgtctcaaaaaacaaaaacaaaaacaaaaaaacaaaaaagccccacctatcccttggcctttgcatcttgatttctgaagactcacatgtcatgtaaaacttacgttaagtaaatatattatgtttttctcttgtaaatctgtcttttgtaatcaggatctcagccatgatgcattttggcttgtcagaaataatcacaacatgtggagaaatagataaaatgccatttttaaaattattattattttttatttttttgatagagtctcgttctatcgcccaggctgcagtgcagtgtcatgatctcagctcactgcaacctccaccacccaggtccaatcagttcttgtgactcagcctccccagtagctgtgatttcaggcatgcaccaccacgcttggctaatgtttgtatttttagtagagatgggatcttgctatgttggccaggctagcctgaaactcctggcctcaagtgatctgcccgccttcgcctccttaaatgctgggaatacagttgtgtaatggtatttttttttgagacaaggtctcaaaatggcattttttttgagacagggttgttgctctatttaccaaagactatacaagattatgtgaacttaaaataatattcgggttaatttctgtatttctaagttttaggaatacttagttatgtaagcatttacttccctttaagtcaattaaatcctcttttaaggaactttataaattaatttggtagtatcattgggcccagtagagttttttttttcttttttttgagacggattctcgctgtgttgcccaggctggagtgcaatggcgcaatctcagctcactgcaacttctgcctcctgggttcaagcgattctcctgcctcaccctcccaagtagctgggattgtaggctcccgccaccatgtccagctaatttttgtatttttagtagaaatggtgtttcaccatgttgatcaggctggtttccaactcctgacctcaggttatccaccctcctcggcctcccaaagtgttgggattacagggatgagccaccacacccggcaaatttcttttaagatattttataaattaatttggtaataccatcagaggcagaaaaatttcacacagatggagagacatacataaacatacaggcaaatatcaaaagagatcttctagctatcattctaaaatcttagccatgaatcagaaacacatagtaatacaaagtcactgttttatatgtaacagttatctctcatattttctccatttcatattttttccctattgtccctggtaaatgggacaagttaaggctatgtactaaatattaggcctaatgctttttaccaatattcatggagaaggtttttaagatcttcatttgccctgtgaagcccttttgaaggctgtggactaaatgttaaatgagtcactgcaaagacatctaacagctatcgaaatgtctccaccacccatctgagtggataaaatatccagtctatttccaaatagtctttttttcctcttcagccttggtacttacttttggaggactctgagtcccttgacagcagggtggactaaagtttaagagaagaagtctgacaggggaggaagacagagagatggagaaggtaggagtttgaagggatcatatccaggactcaaaggaactgaatggaagattgaaagtggcaagagtaggaaggaggaacagaaagagggggaaggaagaggtcttaagggaaccagctgggggagatattaaattccccaaagaggctagtgaagctccaaattatccttagcaaaatcaggccgggtgtggtggatcacttgaggtcaggagtttgagaccagcctggccaacatggtgaaaccctatctctactaaaaatacaaaaattagttgggtgtggtggcacatgcctgtaatcccagctactcgggaggctgaggcaggagaatcgcttgaacctgggaggtggaagctgcagtaagccaagatagcaccactgtacttcagtctgggtggcagagtgagactccatctcaacaaataaataaataaataaataaatatccttagcaaaatcatgccaaaaagagggaggtaggcagaattgtgaaagcttatagccaacagaggttcaagaaaaggctttttgtcaatggataagtttacatgggaagatccggatcaaaaggagagaacagagaggacttaagaaaattgttcctattggctgggtgtggtggcttatgcctgtaatcccagcactttgggaggctgaggcaggcggatcacctaaggtcaggagttcaagaccagcctgatcaacatggtgaaaccccgtctctactaaaaatacaaaaattagctgggcatggaggtgcacgtctgtaatcccagttattcggaggctgaggcaggagaattgcttgaatctgggaggcagaggttgcagtgagccgaaatcgagccactgcactccagcctgggtgacagagtgagactctgtctcaaaacaaacaaacaaacaaacaaacaaaaacagaaaagaagaaaagaaagtttttcctataagtctgtaactatcagcttcccattaggccaactattgatcatagaggtcttaaaaaatcctttcaggctgggtgccgtggctcatgcctgtaatcccagcacattgggaacctaaggcggtaggattggttgagcccaggagttccacaccagcctgggcaacgtattgagacctcatctttactaaaaataaacaaaattagctgggtgtggtggcatgctcctgtagtcccagctactcgggaggctgaggtgagaggatcacctgagcccaggaggtcaaggctgcagtgagctgtgattgtgccactacactccagcctgggtgacagagcaagacactgtctcaaatatatataatttttttcaaatatcttatcaggttttggtcaagaggaaaggtaaatattcctgatagtacattcccattaaaaaaaaatgtacccgttacaagtgacttggaaccaaaatccatagattctttcatggttctttatcggtatggtgatagggttttcatattcatgtgtgagatgtgcctccctcagtccttgttatgacatcattacgtgtctgacatgacaaaaaggaaaagagaaaaaggtggagaaaggtaaaaaataggaaaagaaaaactgaaggaaaaaggaaaaaaacccaatccgtaagccttttatgacttacccatgaatgcagaggcatcttcaaagagggtgcaaaaaatgcagccctctaaagatgccaaaccactctcaaagatagccaaaagaaaggcaggcctagatactccccctgagagctggcaatagatgttagctgcaaatgggttgcaacccacatgtctgtccagctgtattcccacagccccccaacctgatggttggctgcttgcacacacaagaaccaacaacttgtacgccccatcaagtggaaaaccaagccaaattcttttttttttttttcctttgagacggagtctcgctctgtcgcccaggctggagcgcagtggtgtgatctcggctcactgcaagctctgcctcccaggttcacgccattctcccgcctcagcctcccaagtagctgggactacaggtgcccgccaccacgcctggctaattttttgtatttttagtagagacgggctttcaccatgttagccaggatgtgtcttgatctcctgacctcgtgatccgcccgcctcggcctcccaaagtgctgggattacaggcgtgagccaccgtgcccagccgaaacaaagccaaattcttgacacaaaatgacagaaacagaaaagcaatagctgctcctgggagggaaaggatcaataaccaataggcaccacaaaatcaagctacagtcacaatctagataatgaatttttataatttttttcctatccatctgcattgggaaaataagggacaaggagtttttactttcttctcttgaccaggaactactgacagagatctgggagagctgactttggtgaaaattctcaccttgcacaggcttgtgtctgttttccagaatcctacctgcagactccagaatgaagtgtcccagctgtccctttctcgttgccagaaacttctacccttctcattcctttgcttgtccccctgtaacaagagacagattaatgagagaaaatcatgcaagttgatttactgtatgttttatgtaacatgagtcttcataagaaaactaagcccaaaagaagcagttaaacctgagtgttttttttgctggtctgatgaagagcgaagagtcatggagaaatgtaatgggaccaaaaggtgtcagctaagtgtaataaactgggggaaacagcaagggctattccttcagattcctctcagtgtccctgtgtcttcagagataaagatcttttcctctgggtaaagcgtggcagctctcacatgagggttttattacttgcttcagcagaaagtcaaaaagcccttcccaggttttatgacctctttcagcgaaaggtgagaaagtccttcctacacatttggtttctgaaattccttcagcttaaaatattcattatgccaactttccatattttgggttggcatgtcctgaatatattgtcagagcattacagaaaaaatacacccaaacacacacacacacacacacacacacacacacacacacacggacaacacattccctatgactatcttaaaattgattaacctcaaacatttaattttggatgactgagtcaaaaagagaattgaaattgccatcacatatctggtcaagctgaaagatggcatttggtattggaaattgatggctgctggtcatttaacacccatgcctcagttacatatctggctcatgagataagaatgctaaacagtataaacaagacacctcagtatgaaaacgttctgccgttacaaaggtactctctttgtgttactctgcattctctcccagccctgtagcaatttatcctttgtccatatattgaagatagatttgtttacatctactcttagccttcctgaatatcctttgctccaggagagccttaagccaagggtagaaatgacaagacagactctatgtttgcagaacaccacatagtcacagcgatgcaaatggaaaggaaaatatgagaacaaggtctttcaatccagatttggcctatgtttgtattaaaggtgttattcccatgtaagaccttaagacataatattaataataattcagctatgaaaggttcatgttgagttctacttgcatgggcaagctattaggtagaagttaaagatgcacagaacacattagttctttctaggtatatccttagcagagcaaaattgcaacccaagttagaacaggaaaaacttgatgaagcatgaaattaccagctggtctgatgggagatatgatgtggccctgaggtacagtaggtggtgcctgaagcatggtgacagtagtggaaacaccttagggtgacccacaattagtcactctcattcaattccctttccttgggtgtgggaagaacctgccaatagcatgtggcaaaggatatcgttactgtgtttatgctatgttatatgtcaaaagtgaagatatagtgcagatgtaattaaagaaatcagttggctttgagttcattaaaaggcagaatagcctatgtagacctccccttatcagatgagccacttaaaatggctcctaggcagatcacaaggtcaggagatcgagacccccccgccggctaacacggtgaaacctcatctctactaaaaatacaaaaaaactagctaggtgtggtggcgggcgcctgtagttccagctactcgggagactgaggcaggagaatggtgtaaacctgggaggcggagcttgcagtgagccgagatcgtgccactgcactccagcctgggcaacagagcgagactccgtctaaaaaaaaaatggctcctaggccttccctgatgtcagggaaaatagaaaagactctgtctcttcactgttgcctttgaagaagcaagctgccatgaattctatagccattgtaaaatgaattctgccaacaagcaaatgagcttaaaaagtaacagagtctgcgcacagtggttcacgcctgtaatcccatcactttgggaggctgaggtgggtagactgcttgagcccaggagtttgagaccagcctgggcaacatggtaaaacttcatctctatagtaaaatacaaaaattacccgggcacagtggcatgcacctgtagtcctagctgctcaggaggctgaggtgaaaggatggtttgggtccaggaggcagaggttgcagtgagtcaaaatcacccctctgcactccagcctgagtgagagccagactctatctaaaataaacaaaaacaaaaacaaaaacgtaatacaggccactgacaccttgactgaatccctgtgaaatatttcacctgaaaatccagctaacctgtgcccactgacccacaggaatggagataatatatttacattgttgtaaactgctaaattgactggatgtggtggctcacacctgtaatcccagcatcttgggaaaccaaggtggggggaatcacttgaggccaggagtttgagactagcctgagcaacgtagcaagaccctgtctctacaaaattaaaaaattagccgagtgtggtggtgtgtgcttgtagtcctagctattctggaggttgaatgggaagatttctttagcccaggagttcgtggttacagtgagctatgatcacaccactgcactccagaatggatgacaacgtgagaccttgtgatatggtttggctgtgtctccacccaaatctcaccttgaattataatcccatgtgtcaagggtggggccaggtggagataattgaaacatggggggtggtttcccctatactgttctcttggtcatgaataagtctcattagatctgatgcttttataaatgggagttcccctgcacaagcgctcttgcctgccaccatgtaacatgtgcctttgcttctcctttgctttcctccatgatggtgagggcttcctagccatgtggaactgtgagtccatgaaacctctttctttataaattacccagtctcagatatgtctttattagcaggctgagaatcaactaatacaccctgtattaatgtattaatacatgaataaaaaaagttgctaaatatgtagaactacactctgtgtcttccctttagtgttaggaagatcaaataggcactacaagagcattttcttggtaaatggtatctaaattccctcttatcaatggcaattactcatttggactgctaacaccataggggcaaaaatcctgacatgtatgaatcttgtgggagaagcacttggaaaaaaaacaaaaacaaaaacaaaaaacagagacaaacatttctgagcaaaaatgcaagctttttaaaaaaaatagtttgttttgatcagttcacatcatgtaggtcatttcatccggcctcattggcatataagtagtatatattgagctaggcgtggtggcttacgcctgtaatcgcagcactttgggaggccgaggcaggcggatcacgaggtgaagagatcgagaccatcctggccaacatggtaaaaccccgtctctactaaaaatacaaaaattagctgggcatggtggcgggctcctgtagtcccagctactcgggagagtgaggcaggagaatcacttgaacccgggaggcagaggttgcaatgagcgaagatcgcaccactgcaccccatcctggcgacagagtgagatctgtctaaaaaaaaaaaaagtagtatatattgaaagtataaaggggtgaaccactttgaattgcgtatgacaaaagaagctcagagttcaggtgaaaaatgtgttattacaaactcaactatcaatttaatctgtctttaatgtatgagtcaaaattaagtgttttctgttggggtgatcggacccaacaccaggccgtgggggcgatgaagtcccacggagtcaaaggaatgagaaaagacaagttaagagagaaactgggaccaggggccaatgctagtatggaggctgcgaaggccccaagctctgggaccccatgctatttattggtgatcaaacaaagaaacaggtggcgaggctgtgggggttgaaaggaagtggtgtatcaagcaaatgagctacagctgtgatggtttagcattttctttgaaacatatggctacttgagataatgggagtgctagaagcaaggagccagcaagtctagacacattccaaaggccacaaggggttttagaccctggaccccagacacgttccaagactcttttacattatgtcagacatccaggccctgcctcaaattctctcccaacactcagcttttctcccaacactttctattacaaacatcaacggaaaaatcaatgatctgtttaaaatattgtaaataccatcactatgtttgaagatatgttttaattttttattattcctttaattaaaagaactgtatgccaattaataagctgttgccttttagatcaaaattaatcattcattgcctgctctgtgaaaattgagtcagatacccttaaaaatatattgtgttgcaatagtaagttttttcagtaattgaaggtggttggacattgtaaaaagagattttcctttctgattccactgtggtctctcagccgtttcccatagcatgcatgcctttctccagcactatatttctacagtatgcatgagcaatcctgcagcaacaatggcttttctagcatcaggctcctacaacgcatgacagtcagcagcactagtggtcagccacttcctatatcccctacccttaggtggtttctagtgtagtgcttccaataatatacctacctgtgaacacctttccctggcacctaagtgggaagatttctggaaagttccactggtgccgcacactgtgactattctgtgtagcctctaacaagctctggattgcaatccacttatagtaaataaatgtccacttcaaacattccctcctcaaattcttgtgttttgtctgcctcctgattggaccctcactgaaagaattaatgctggcattgttccaagagatatttccacagagatgaatctgggaggttgtgttggtcattcctttatgtttgggcacattccacagctccttgtcaatgtgcaatgggatactagcaacctatgacatgcagtggtatcacaattaatcaagcaatgacctgtggttgattgtggcaaagtgccaactgaaacacgtgccttgggagcccgagtgactgctgcactgaatgttatggcagtcaagataactgtaaggactgtggggtggaatggattcagttgagggtccttgagtgattacgaacagaaaataacaagcttaggttccttaattctcagttcaagccacggtttgaaaacctgagaacttccatggcgactataaaggaaattcatttgttgtagctgcagggctgatattgttaaatatcaaaaccaagaatgagatcctgaaacttggaatgggtcaggaaacttggaatgggggaatctgtttagactcagttgaaactgaccatctggaaacagaaagtcaggctgagcctttcttaccagtttaagtagcttgtctctattgtttgaagaaaatatctttcccttgcacaaaagctgggttagataccattaaaggggatgcccatttttcttaaagtcccctacaaatcatcactttttgctagtagcatgactagaccccataactaggattgaatagcaacctattcctaagggataggtacacactatgacctgtaggaaacagctacatgcaaaaggaactgtgacatatattggaagaaacctggggaatgttggaagagcattctaaggccgttatactaaggaggacaaaatataacagtagattgggttaattaatctcagtgctattactggggattcaagatttattgtgctgcaggcatgtggctcacacctataatcccagcactttggatgccaaggcaggaggataagatgagtccataaatttaagaccggtttgggcaacataaagagaccttgtatctacaaaaaataaataaataaataatccagtgagagtggtgcacctgtagtcccagctacttgggggctgagatcagaggatcacttgagccctggaggttgagggtgcagtgagctgtgatcatgcaactgcagtccagcctgggcaacagagccagaccctgtctcaaaaaattaacaaaaaaagatttattttgtagttctcctggtagagatctttcatctccttggttagatgtattccttggtattgccgtcttaggtagaggaagagggctcaaacatcttgcttatgtgataactttgccaaagacacaatgtacaatttgttttaaaggccagtgagggatgtaccagtaatcagaatgttttggcaaacagaagactttggtggtagctaactgatcacagggtccctagaatgaaatagatgagaagcatacttagagtattgtttgatctctatatcaagaaaagttccgggtctggtagtcaaatgttcaacagatgcctacctagctttcaaccctaagtcaattcacagttgcagagtgataccacacggaccatgaaaagaacacttgtttgtatgactgagacaaaaaagaatgtcatcgtgttctaccttacctgggaatatgctcaattggtgacaaaattgttgccactctgtgcatgaccacaaaagtaccgcaggtattgattttgaagttacacataaactttagtgagtgggcatatttgcaaatatgtaacctgagaataatgaagattaactatctttaaacaacataaggagtcaacatcagtttctgaagtaaaataatgactaagttaaattttcaagggcaaattcagattccaagtgcacagaacataggaagaaaaggacatgcaaatcagaaaaattcacaagtgtaatgaggcgagaagggacatggcgcaccaattacaaaggaatcagaatgatctgttcatagagttgtaaatggggttgtggaggaagaaatgaggatgaacagataggcaagacaagttcttttccttctatgtaaataagagaaactgagaaattgtaacgtaagacaagatctaatattatttttggacttcagaatggtattgcataaatgcttaattgttcctgatttcgggaggggaaaatggaaatagcatttccgttgcatttttgtgaacaaaatttgagtgatcatgttctttgttgcatgtggtagatggagaggtgaatgaaagattcagctttcttcctgtacttgaggcatctgtgaattgggaattcagacaaacagataagcaactaattctggatataaaatttgtgatttaggctatgcattctactggggaatttcagatgtataggaatgtagttgaaatttaagtggtcagggaatgctatctagaggaagaaaattatgactagagacaagaataaatagtagtaacttaaaaaaatatatatcagggaagaaaaaatggatttttgttccaggaaagaaactaagtatgaacagatgatgaactatttcaggaactgtgtctgcaattcgttccttccagtgggttcttggtcttgctgacttcaagaatgaagccgtgcaccctggcagtgagtgttacagttcttaaagatggtgtgtccagagtttgttccttcagatgctcagatgtgtccagagtttcttccttctggtgggttcgtggtcttgctgacttcaggagtgaagccacagaccttcgcagtcagtgttacagctctcagtccggagttgttccttcctccaggtgggttcatggtctcgccggcttcaggagtgaagctgcagacctttgcggtgttacaagcgttacaagctcgtaaaggtagtgtggacccaaagagtgagcagcagcaagatttattgcaaagagcaaaagaacaatgcttccacagcgtggaaagggaccccagtgggttgccactgctggctccggtggccagcttttattcccttatttggccctgcccatgtcctgctgattggttcattttacagagtgctgactggtccatttttacagagtgctgattggtgcgtttacaaacctttagctagacacagagcactgattgttgtgtttacaatcctttaggtagacagaaaagttttccaagtccccacccaacccagaagcccagctggcttcacctctcagaaccacagatacaaattattttatttacctgaatcaatctgaaagcatatgctggggctggatgttgaggatacttaatggcacattaattctttgattttgtatatgtttagatacattcattagctacagtttgcagcttcctaacagggattccacagatatgactgtaaattgagaattttggtttcccagtgtctgaaaagtggttaacccaaagttttggctttagagaaagagtctatacaggcaaaagcgtagagggtttggcagagaaaaaacaaaaacaaaaacaaaacatcctaagggccaaaggaaatggttgcaaggaaaacggtcaaaaacttgcatcattctcttcatccactcacaccactctatgcaggatcccaaatcagtccttgaatgtttcggcacaggttccattcatgctttccaatggaaacttcatttggtttataggattcaggattgtggaaccatccggtatcaagaaaataaaaggccatgaaaaagtttacagaatgttggtataagcagctgctagggatattactgagttttaatgggagagatagtcccagaaagctggaagaagaaagatcagggccaagcgcggtggctcacacttgtaatcccatcactttggaggcagagaggggcggatcacttgagtccaggagttcgagaccagcttgggcaatgtggataaaccccatctctacaaaaacatacaaaaaattgctgtgtgtggtggtgcacgcctgtggtcccaggtatttgggagactgaggtgggaagatcacctgagcccaggaggtggcagttgcagtgagcagagctgaggtctggccactgcattccagcctgggctacaaagcaaagtcctgtctcaaaaaaaaaaaaaagatcggagcaagaaaaaggaaaaagatgggtaaaaacatagaaacgactaagttcatttcagcaggaatatatttttaaatatatttcaaaactgaaacaatgctatgttttgctgcagtgtgtgagggaacacaattcaggctaatgcacagtaaaaatgcagggaagcctggccccgtaaccacttttaataccacatactacagttaacagttggtgagaaccctattaggctgatttcaattacaaacatggatgtacaggagtatgttttaatggcacacatgcatagttcatattttattagaaaatctgttcaggccggctacagtggctaacgcctgtaatcctagcactttggaaggctgaggcgggtggatcacctgaggttaggagctcaagaccggcctggccaacatggtgaaaccccgtctctactaaaaatacaaaaattagctaggcatggtgccgcgcgcctgtaatcccagctactcaggaggctgaagcaggagaatcgcatgaacccgggaggcagaggttgcagtgagccaagatcgggccactgcactccagcctgggcaacagagcaagactccctcttgggaaaaagaaaagaaaagaaaagaaagaaagaaaatccgggctgggcacagtggctcacttctgtaatcccaacattttgggaggatcacttgagatcaggagttcaagactagccttgccaacatggtgaaaccttgtctctactaaaaatacaaaaattagctgggcatcagctactcttgaggctgaggcaggagaaaggcgtgaacccgggaagtggagcttgcagtgagccgagatcgcgccactgcactccagcctgggcaacagggcaagactccgtctcaaaaaaaaaaaaaaaaaaaaattagctgggcgtggtggcatgtgcctgtaatcctagctacttgggaggctgaggcaggagaatcgcttgaacccagaattcagaggttgcagtaaactgagatcctgccactgcactccaggctgggtgagagagcaagactccgtctcaaaaaaaaaaaaaaaaaattaaaaattaaatccaccaaattagctcaagaacacttccttgactggctcagaaatcccatccgattttaagatagatgttaaaaaataacagggaggaccgggtgcggtggctcagacctgtaaacccagcactttgggaggccgaggtggggggattatgaggtcagcagttcgagaccagcctggccaatatggtaaaaccctgtctctactaaatatacaaaaattaactgggcatggtggcgtgcgcctgtagtcttagcagctcaggaggctgaggcaggagagtcgcttgaacccgggaggcggaggtggcagtgagccgagatcaagccactgcactcgagcctgggtgacagagtgagactccatctcaaaaaaaaaaaaaaaaagacacattatttcattttaataatgttagtcaattttttttgttgtcgatgagttgcgttttgttcattaagaatcagctgtaacatttgttgggacttggtagaagataactgctaggtggttgtagctgccaggcttttaatgagaggagcttagtttagcgaaaataaaagaaaaacaaagattaatatttggaataaactgtaaactcagcttctgagtccagagatcagccagtcaagattgtttagacttgagcttatctttagatggtgaagttaggaaggtagtgacagtctaatgagttttcctagtttacagtttgtatgtctttggtgattacatccagtgttctggtgaacttcctgaggggcccacccagcaacagacacaaaggtgatttatttgaaactgtaggaacgaaaaagtaatatattttcatcacccattacaaggttaacgagtgagactcctataacaaaagacatattaataagaaaaaataatatcaaatgtagttactaaaagtattatgtgacatgggagcttttagaaatgaagatcaaaagaaccagggagaatcctgggtttttttgtttttgtttttgtttttaattgagacaaggtctggctttgtcaccctggctggagttcagtgacacgatcccaggtcacttcaacctccacctccatgggctcaagccatattccacctcagcctcccgagtagctgggactacaggtgggtgccactgcacctggctaatttttgttttgttttgtttttgtagagatggggttttgccttgttgcccaggctggtcttgagctcccaagctcaactgattcacccaccttgacctcccaaagtgctgggattacagacatgagccaccgtacatggctggaaaaatctatttttacagagagctatgcaaatgtgtgattggaaaacaaatgggtatgacctagtggcaataatctgaggagaaattagccagatctgttcagattcttcttggtctctgcgtatagaaaaggactgctcctgagtgaggaatttatgacctactttccggggaggtaggtcagagaattcttttgtgacccacttcagggggaagaggtcaaagactgtgcttcctgcatctattatctcaatttctgaggtgccatatttgggggcattatttacagagactcaagggggtgtaagtgcctattatcagaggtcattcttacggaggctattaacgaaattttaggtgaatggctgagcagacatctagaagttgtcatccagtctatttctaattaggttttttcttttctgacgcaggtagttgattttgcaggatctgctgtcccttaggagaagagggccctaaagttcaagtgattgtgggactggaggagataaaaggctggcaggggagggcagagggagggaggatgaagcagttaggggcttgaagggggaaatatcaaaggaggcaagagaactgaagggtaaaataatgccaaaaaagaggtggacagagttggcaaagcatatcgtaagcagggatttgagaagaggggattcagatgacagagaacatcccaagggagaagcagaatccaatatagagaatggattggtcttaaatagagctgggagtaaaagattcgcagcccaggaagtcagggaataatacctacggaggaaggacttccaggccaagtatccagggaataatccccactgctatggttctaatgatggtgccctctcaaaaattcgtgttgaggccgggcatggtggcttatgcctgtaatcccagcactttgggaggccgaggcaggcggatcacaaggtcaggagatcgagaccatcctgactaacatggtgaaaccccgtctctactaaaaatatagaaaaattagccaggcgtggtggcggtcgcctgtagtcccagctactcgggaggctgaggcaggagaatggcatgaacccaggaggcagagcttgcagtgagccgagatcgtgccactgcactccagcctgggtgacagagcgagactccatctcaaaaaaaagaaaaaaatcatgttgaaatgtaatcttcagtgaaatagtatgttgcccaggctggtcttaaactcctgggctcaagtgatcctcccacctcggcctcccaaaatgctggcactataggcataagccaccacgcctggccaagacactaccttgaaagcacagagtaggccaggcgcggtggctcacacttgtaatcccagcactttgggaggccaaggtaggcagatcatgaggtcaggaattcgagaccagcctgtccaacacagtgaaaccctatctctactaaaaatacaaaaattagctgggcatggtggtgggcacctgtaatgccagctactcggggggctgaggcaggagaatcacttgaacccgggaggtggaggttgtggtgagccaagattgcaccactgccctccagcctgggcaacagagctagactccatctcaaaaaaaaaaaaaaaaaaaaaaaaaagaataagaaagaaagaaagcacagagcagcccttactagacacaaattatgccagtgacttgatggcgtaattggacttcctgactccagaactgtgagaaacaaatttctgttctttatagatttcctaggctcagttattatgcttagcggcacaactgactaagatagaaattggtactgagaagtggcagtgttgcaataacaaatacctaaaaatgtagaggctgctttggaactgagtaatgggtagaggctggaagagtttggaagtgcatgctagaagaaggctagtttgccatgcattaaggcgattctgacgaggcttcagaagatgaaaagccatagagaaagcctccgtctttgagattatctaggtggttgtgaacagaatgttagaaagaatatggacagtaaaggacattctgatgaagtcttagatggaaatgagggatatcttattggaaactggaggaaaagccatccttgttacaaagtggcagaggatttgttcctggaaagaacagaacaaggtctgggaaagaagggagtttatttctgcagctggttacagggagaaggccggagtaactcaccataccaactcaaagttacaagtttttttctagtgcttatatacattttaagctcccatgctaggagtggaattgcacctccaagcaggagtgtttccttcaatctatatctaaactttaactaggacctagggtctggaaatctttctctagagtcttggaaagctttttaatctttttttctttttctttttttttgctgtccataagtttattgtctgtatctgaaaaatcatcatagaaaattgtttggtttagctctcagcagcctgcttctgagctctgaggaagcttgcattcttttgagctacccaatccttcttctgagcaagggacattttgggatggttccacctcttctttttaacttctttcttgggcttattttcatagactggattctctcgtatagcagcatgagcttccttatacatttcctccatcatgtctggagttaccctgttctttatgtattgagagaactgtttcttgtaagcattttcatcttcttccattaagtagcacatgtaatcggcaacattctggcccatgatgtgcttccggtgtacttctgcattaaattccttgctttcagaaccataaccagggaattgtttggtactgtgagggatagacaagcctccatccacagctcccttcagggcaccaaaaactttattgccagtggtagttctggcaaggcctgcatccaaatagcaggtaaaggcacttggctgaccatcaatgctttccacaatgtattcatcgccagtcacctccacttggccttcatagatcttgtccatgccaaacctactgagaagcctgcgggccagcggcaggccagtacaatatgctgcagcataatttgtcgggccaaccttcacaccatattttggcagttcgtgtgcatatgctgtgcagactatcatatccccctctatatgggcataagcaatctgacaaatgatatctctgtttgttacacgaactatcatcctgtatttgagtgtgttgtatttatttttatcctgtatcaccaagcgtttccgagtatcgtaatcagttttaccctctcatcatcgtcttctaaatttcacttggtatctcttaaagtaggccttattcttaacaactttaacaaaccccatcctgcagaacagagacccgcgtccacagctcaacagagaccagcaggcacagcggcgctggggcagggagaaggggaaagctttttaatcttcagtgggtacctggaacaaggtatctgtgtaaaatgcttttattattcaaccagactttaggctaagaaagcccattttaatgggtttattttaatattccagccctcatgctcagtcacctgtttctccagttctttaatgtttaacttatacattcattagaattataatagagggtcagtggaaactgactgttctggttgctaatgggagcctgccctgccacaaacttggtggaagtatttctgtgtcttaatagttttttggagggtagaatgtaagagcgatgaactaggacatttggcagaagaaatctctaagccaagttttcagggtactgcatagcttctcttaactgcttatagtaaactgtgagaagagaaaagataggacttctaatcaaaagggaagcagattagctgggcatggtggcacacacctgtagtcccagctactctgcaggctgaggtaggagggttgcttcagcacaggaggtcgaggcggcagtgagctatgatcgtaccacagtctgggcaacagagtgagatcccatctcaaaaaaaaatgctaattattattattattatcattgagatggagtcttgctctgtcgcccaggcaggagtgcaatggtgcgatctcggctcactgcaacctctgcctcctcccgggttcaagtgattctcctgactcagcctcctgagcagctgggattacaggcgcccgccaccacacccggctaatttttgtatttttagtagagatggggtttcatcatattggccaggctggtctcgaactcctgacttcgtgttccacccacctcagcctcccaaagtgctggaactacaggcgtgaggcacctcacctggccaaagactattattatcattattttatccaaaatgtgtttattgagatggtttcccactcatcttgattcagggtgcttttagtgctgctttctcctgaaggaccatccttccataagccttgcttttcctcctgtaggctggcagaggaaagtgcagcagccaacacccaaaaccactgttggcacatggctaaagaccgtggtgattttatagcatcctgggcatttcacatccatgaagtaggaattggggctctgcaccaggtgtttcttcttgtgtttcctcttctcctcttctggagagggatgaaggagatcctttgcaagaagcatgttcttgtgggtaggtcgtcagtgctggaaagggccaaagaaaattatttttaaagggaagttgaacataaagatttggaaaattaacagcctggccttgtaaagaattttttaaataagttcaggagacaaaaccaactgtgtggccaactgaccgtttcataaggagattagtatgactagaatgccagatgctattcattaagacaatgggagaatgaccctgaagacatttcagagagcactgagaatgccacaaccatcacaggcccaaagtgccaggtccttgagggaataacaattttaaggaaggagcccaggattccagtgcaacccaagatgcctgtgggaacttggggctcactgactatgctgcctcatgtatctgctccctgaagtcaagcaaagcttccccatctgtggttcaggtgggcccaggtacagctcagatcactcctccagaaaacacaagtagtaaaacatggggcagcatgcatgtggtgctaactgcaggcatgctaaatccacagctgtgaaggcatggctttctccacctaatttccaaggaagccttgaagaatgcctcagggcccaatcagagaactgctgtaggggcagggctgccatagaaagttcccactagggcaatgtccagcagaactattgggttggggccaccacagagtgccctcactagggcaatactcagtggagccatagggacagggccacccctgagttcctagacccagacctgtagatccggtagtgcgtattccaacctgtaatagacatagacacctgactacaacctgtagaactgtggcatgggctgactccagcagtcatggcagcagggtcccctgggggcttgggaacctaagcactaccccagtgtctctgtaaggtgagaggtagaatcaaaaaagctgactctcacacctcaagattgaattttgttggccttgttgggttttgaagttatgtgggacatgttacccctatcttcttgcctatttcctccaccaaccttttgtttttgccatggggtcgagctatgtcacccaggctggtctcaaattcctgggctcaagagatcctcctgtctcagcctcctgaatagctaagactgcaggcaccatgcctggcttatttctgacttttataaagggaatgtttatcctgtgcctgtccaaccattgtattttggaaacacataatctgtttgacttcacaggttcacagctggagagccattgtctcgggattaattgtaccttgagcatcacctatatctgatttagatgatatttacatgcgactttcgacttacacttgaaagttgatgctggaatgagttaagacattttggagttactaagatggaatggacatattcttgtgggtgagaacgacatgaattctcatgtcatggcaagggtggagtgctatggtttgaataatggtgtcccttctaaaattagtgtggaaatttaatgcccaatgcaacagtattaagaggtttggcaattgcgtggtgactaagccatgagggctctgctctaatgcatgagattaacatctctataaaagtgtattaatttaaagggagtactttcttgcccttctgccccattcaccatgtgaggacatagtcatggctcctccacaggatgcagcaacaagacatcatcttggaaacagacagcagccccgtttagacctccttctgctgctttgatcttggacctctcatcctccagaaacacgacaaataagtttatgttctttataagttactcattatcaggtatttatttatttatttttttgagacagagtctcgctttgtcgcccaggctggagtacagtggtgtgatctcagctcactgcaacctccgcctcctgggttcaagtgattctcctgcctcagcctcctgagtagctgggattacaggcatgcactaccacacctggctaactttggtattttcagtagagacagggtttcaccatgtttgccagtctgatctcgaacccctgaccttaggtgatctggccccatctgcctcccaaagtgctgggattacagacgtgagccactgtgcgtggccaatatcaggtatttctaatagcagtacaacggactaagatactcaggaaaacagagccaggaggaaaaatattctatctcagggagttaaggaatcatgcccactcaagaaagagtataagggctgggcatagtggctcacgcctgtaatctcagcactttgggacgacaaggtgggcagatcacttgaggtcaggagtttgagaccagcctggccaacatggtgaaagaccacctctactaaaaatacaaaaattagccaggcgtggtggcacatgcctgtaatcccagctacttgacaggctaaggctggagaatcgcttaaacctggtgggaggcagaggctacagtgagccaagatcacgccactgcacttcagcctgggtgacatagtgagactccgtctcaaaaaaacaaaacaaaacaaaacaaaaaaaacaaagaaaaagagtgtaggggaaaaataacactcagtttattttttagtccaaacagacccctttaacaaaataaagattaacaagagaaaagcaaacaagtttattaatgtgtgtatttcatctacacatggaaaatacccagagaatgaatagttatcaaagaagtgctttgaattccagcatatatagcatcttcagcagagaaccgtacatttttagagaagtgaaaagataaagaaaaaggagattgtgtccgtaggggtgacaacttacggaaaggcaaataaattgcagataaattcagttactaagcatgttgctataaattcctttggtatcatttccaggctgaccagggtctaaagttttcttcagtggttagcctttgttctccctggtaaaagcgtgagtgtggagagtggggagggagagggtaccttttgtcttcgcaactctatatcttgcttttcggccagtaaaggaagaacaaaaaacttccctgcatctgcttcttcttaattgtcttcagctcaacaatgcttccagttttagggtggcatattctggcctcccacaagagccaggaagaacagatgtgcagcccaacggtgaggaaataattttcaccctacaaagagccaggaaaaagaccttccattccaggaagtacctttcaaaagatacctgggagtctaatccagcttcaaactatactctgaattcttaagaatcaaggccaggtgtggtggcttatgcctgtaatcccagcattttgggaggctgaggcaaggggatcgatcacttgagcccagggtttgagaccagtctgggcaacatagcgggatagtgagatcctctccacacacaaaaattaaaaataaaaataaataaaaaaaattaaaacctatccttacaagcttcagtggacacttgtccagagcaatcaatggctccagagtctaattcaccagtggatccccaatcaacttattaggaataaagacaaggtttcaaaggtgcaccctgaggtcctgggtgagaggtccaggggaccaaaaatgaataactgaaaaaattatatattcagtgatacttattaaagcatggtaaagaaaactttattcaggaccattgtgatagatacagggaccaatgcaatgggattttgcaatggaatagagagattgctctgaactccaaatagatcatgggaaaaagggacgttataaccaagaagcagggttggggtgtagtgggtgaaggaatggaaaattactaaaaggaaacatcagggataagggggattctggctaaactgacacctaacaagattcttgttaaagatgggccagagtggtcatgtatcacttggaagatggtggaagatgaacctgatcagatatcaagggtgatcagatatcaaggagaagagggttcttttttatatttatttatttatttatttttgagacagagtctcgctctgtcatccaggctggagtgtagtggcgtgatctcggctcactgtaacctccgcctcctgggttcaagtgattctcctgcctcagcctcctgagtagctgggattacaggcgtgcaccaccatacccggctaatttttgtatttttagtagagatagggtttcaccatgttggtcaggctggtctcaaactcctgacatcgtgatctgcccgcttcggccacccaaggtgctgggattatgggggtgagccaccttgcccggccgagaagagagttcttgataaacagacttccttgttaaaactagattttataatgaggtccacagatgggtggaggagaagcctgagtaaattttggttaagcagagaaactttgtcatccctcctgtatgcattatgctcccttttctccagtggagctctcttcaaccttgatgttattgtccaatcagtttgttttcccagtgttgatgttctgatttcatcctacaaaaatatagcataaacttgtatttgttgcattctacaacataagcctgacaatataacaaactgttcccaaagttataaattcctcgtctttttatttgtaatttgacttttaaaaatctatgtaattatagaagaatgttgctactataaaaattttaaggggtggcagggaataattccaaaattataaaactccttgtgacaaatttaggaatgatattcagctagttctatagttttttattccttgaataatcagcgatatacatctgattatatacacacattgtggtttttttttggccaggttgactttttttttttttttttttttgagatggagtctcactctgccacccaggctggagtgcaatggcacaatctcggctcactgtaacctctgcctcccggattcaagtgattctcctgcctcagcctcccattacaggcacccgccaccaagcctggctaacttttgtatttttagtagataatggggtttcactacgtgggccgggctagtcttgaactcctgacctcgtgatccacccacctcggcctcccaaagtgctgggattacaggcgtgagccaccgcgcccagccttggttgacttattcttttaaggagcaatgtgggttaatgtttcaaagtgaaaaaatttaaaaacttaggggaaagtggggggagagagagacaaagacagagacagaaagagagacagagtgagagatggagagagatcagataggtacataagcttagtgactcagcctgtagtcccagttacttaggaggctaaggcaggaggattgcttgagcccagaaactcaagttttcagtgagcagtgatctgcaacactgcactccagcccatgtgatagaaccagatcgtctctagaagaaaaaaaaagaagaaaaaaatacatatacatacatacattggtgtttgtttctacatatgcttcatagtatatgtgtacatggattataggtagatcatataatggtaacagtattaaattaggtgtcagcatttgttgaggaagtagtacgctcgtgtttgaaattttaattaagaattgtgtacggagttggttccttccggtgggtttgtgggtttgtggtctcactgacttcaagaatgaagccacaagccttctgaaccttcgtggtgagtgttacaactcttaaaggtggcacagacccaaggagtgagccgcagcaagatttattgtgaagatcgaaagaacaaaatttccacagcatagaagcagactgagcaggttgccactggtggctggggtggagtggccagcttttattccttatttgtccccacccatatcctgctgattggtccattttacagagtgctgactggtccattttacagggtgctgattggtccattttacaaacctctagctacagagcatcgattggtgcatttttacagagcactgattggtgcattttacaaacctgttgtaagacagaaaagttctccaaggccccacctgacctacgaagtccaggtggcttcatctctcagaatcagcttttaaaggccataaatttccaggtaagtaggaatagaagaaatgaacatttcctttgagatctatgatgtcatatttttttctccatcaacgatttagttccttctggatcaaatactttttaaatggatgtatgttttatagtagatgttatgttgtcttaattattttaaaactcctattcctggactctcctgaagaggagaatttagtaatttcgaagtattttttgaggctagggaagaaaaaccaagattactgcataaggtttcaggggatgttccatgcctgccacctggtgaaaatgagggagctttcctcctacctgccaccattacacctgcctgcaggtaataacgccatcatttcaacgcggcctggggtattctgggaaggtgacgtgtgggggcgcagtgaccgctagcaggggccaaacccgccctggtctgcgctgcagtgcgcagtgaggatgttggtgctgctcttcagggttttctttccgcagccacgggaagcccgtgttccatatttgtttttcatgttctctcgtttttatgttgtggatttagttttttaaaaaccataaatgttcctctacagtcttaacaatgtaccctgtaaaataagattttaaaagagccaacttccctattaatcttatacttttttcttttcgttctggctttaacaaatgtgacctaaagagagctcttgattttatgtagaacaatacaagaatagttttacattaatcttatggttagaaaaatcatttatgggcaaatttgttcccatgccttacttttaaaatattgtgttgtctttaattttcaaaatactttaaatatttttcagtaagtttgagggtagaatttattttaatgagactcctcttataaaaagtacgtatctgtatgtgcatatgtgtatactgaatttgctttgcttttgattctatcattctgtcacttttctatcaaaatatctctaatggacagaggccagagacaaggacttttacagcaaatttgccacagtaccacacattttatcttaaaagatggtatggattttgcataacatatatatgcaaacatatatatatataacataatatatatgtgtatatatatataacattatatatatgtgtatatatataacataatatatatgtgtatatatataacataatatatatgtgtatatataacataatatatatgtgtatatatataacataatatatatgtgtatatatataacataatatatatgtgtgtatatataacataatatatatatgtgtatatataacataatatatatgtgtgtatatataacataatatatatgtatatatataacataatatatatgtatatatataacataatatatatgtgtgtatatataacataatatatatgtgtgcatatatataacataatatatatgtgtgcatatatataacataatatatatgtgtgcatatatataacataatatatatgtgtgcatatatataacataatatatatgtgtgcatatatatataacataatatatatgtgtgcatatatatatataacaatatatatatgtgcgcatatatataatatatatatgcgcacatatatataacaatatatatatgtgcatatatatataacataatatatatatgtgcacatatatataacataatatatatatgcgcacatatatataacataatatatatgcgcgcatatatatataacataatatatatgtgcgcatatatatataacataatatatatgtgcgcatatatatataacataatatatatgtgcgcatatatatataacataatatatatgtgcgcatatatatataacatagccgtttggtttattttatgtgtgtgcgttaaaaagttattcaattgctgggcgtggtggctcacgcctgtaatcccagcactttgggaggccgaggcgggcggatcacgaggtcaggagattaagaccatcctggctaacacggtgaaaccccgtctctactaaaaatacacaaaaaattagccgggcgtcgtggcgggcacctgtagtcccagctactcgggaggctgaggcaggagaatggcgtgaacccgggaggcggagcttggagtgagccgagatagcgccactgcattccagcctgggcgacagagcgagactctgtctcaaaaaaaaaaaaaaaatattcaattatgcttgttaaagcaaggtaagggtcaccatggtgataggtacagggacctctgcagatagagattgggctaactccaaacagcgtaggcaagcggaaatttataaccaaagagcaggctgggaggtctgtgaatggaaaattaccaatgagaaacctcaaaggttagggggattctggctaaaccagcctaacaggatttttgctgaagacaggccagggtgatcaaacatcacttgggggatggtgcaggatgatgaacctggtaagatattaagggtgatcagatatcaaaggtaaggaagttcttgctaaagctggatttgacaaggaagtgcacagactggagaaggttcaggtgcctgactaatgtttgatcaagcaaagaatctttgtcagtgtacagaacgctatgtttttataaaatgttcctctgccccatttgtatctccccttttcatggaacacaaagcacgttttgcataacttctagatacatgtacttctattttgaatgacctgatatatcttttttctttacaattctcaacctcagcatatgtaagtggaactcagaaggcaacattccctgaacatactcttccaccagaatctcctctacagatttttgctgccccttttaccagtggctgaatctactttctcttatgtaagtagaaattttatatatctccagcctcttcctccttaccttccacttgcatgcacatcctgtctagtctgtgacctcctctgttataaatgcttgtaaacctttttttctgaatcagaaacgtgttgtgttgctcaagccgtgttcattttaattacgatttaactgcataatttaattatttccccattttttggatacagtgtttgcttttctccggttactttgttctagtatatccctctggcaagagcagtcatttccccacttgagtgtgcattagtatcacctgggggcttgttaaacacagcgtgcaagctccatcccagggtttctaattctcagggtttggtttgcggcagaagaatctgcatttcgaacaagtgccaggactggtctgaggaacacacgttgagagaggtgggattcgggttcactaacctgggttagagaaaattacagtaatgtgccaaatctgaggagggagcagagctgaagcccagtttcaatatgtgaatgagtgctttatacactcaaaccccctcaagggctggggagtaagggagaacgtgggcgggcagcgggcgtgtatagaggcataaactcaatcccagacctatggattcagaatcacatgttaacaattcttccagtgttttgtatgtttattatagtttgagaatgactggaccaaattgcctccaaaatcttaagtcccagcagtgaagcgaagctcagacatcatttgcatagctattgctttgtgtctgtgttttaggtcagctgctgttaaaggtttgtttcggagagttacccaggtgtagtacccttccaagtagataatgattgaaagagtatgtgctggaggtgtatgatattttccatccacttcagcccatttttctgatgggtcagtgacagtccatgatttgtctggtgtaatacaaattctggaagtggcatatatccaaggacagccataatattccacttggccaaggctcttctgacaggctcatgttcatgcaggatcagatctgacccagaatcaacagaactgaagctgcaaattcagctttgtgaaggcttcagatgtagccatggttaaagaagattgacattaagcaggtgagcagagtttgcttgaggttcacccagggaattcgtgaggatgcaggtgcgtttttttatggcctgaaaagcccagtttttgaggagttacagtccctctcagaaactgttcctgcagagtagccctggaaacatgtttgtctgcattcaagaaagatcttccttctgttcatataaaggaagccaaacttatttcccaggtaagggagtggaagcaactgtgatacggaatcctaaggcatgggggttagttgtaatccaggcaatatgtagggtcaggttctccaagtcctcctgtggttaaagggctccaccctaggaaagtgagccacccagggcttggtaaatgaccttatgatcagcccttggcctgttaacatgtcgtaactgaggcacaggactgggttcttggtttgaatttgctagtcagatggccattgcagaaagggaagagagcacagtccttcaggccaactcacttggcctattgaaactggcttttctgagcacagtctagtattgttgcgaattaaatacagcagaggatgtaagttaccagtattagtcactatcagttgagtacttattctgtatcagccactgttcctcttttccatttccacctgttatatgttagtgacgataaaaatgccatacagaccgggcacggtggctcacgcctgtaatcccagcactttgggaggccaaggcaagtggaccacctgaggtcaggagtttgagaccagcctggccaacatggtgaaacctccgtctctactaaaaaaaaaaaaaaaaaaaaaaaaaattagccgggcaccgtggcgggctcctgtaatcccagctactagggagactaaggcaggagaatcgcttgaacctgggaggcggaggttgcagtgagccaagatcgtgccattgcactctagcatgggcgacaaaagcaaaactccgtctcaaaaaagagaaaagaaaaagccatacaaaaaggctaagagccttgttcaacctcacacatgaaagtggcagggctggggtattaattcaggcattcacaatccagatcctctacacatttcactgacatgaaacccagaaatttcaggtctactaccttgaacccagaactatttttctcaaacttgttttcttgtgagctatatatagggaaaaattgcatacaatacagtactgctttacaaatatatcatctaatacccaagtcaagaaagacatgatcctgagctccctcaaaactcgtgggtatcccttctgaatcttgaccttttattctgactgagatgaatcctccatgctgctctttgtaattttattcctcgtgattacatacttaagctacaggaatacatcttacgtagttttgtttattcttaactgtatgtatttttttgtcttttccacttgatattgcattttctgtatttatccatgttgtgtgtaattccagcttcttaatttttattgatggtgttctctcattatatataatatatacagcatgtagcatgtatctttctcactgtgtatgtatacagagtgtatgcatatcactataggtatacagacatatcattatcctagtatttccatatctatgccacagtaggcagatccttttttttttttttttttttttttttgggaagacagagtctcgctctattgctcaagctggatggagtgcagtggcgcaatctcagctcactgcaacctccgccttctgcattgaagcgattctcctgcctcagacccccatgtaactgggactacaggcacctgccaccacacccagctaatttttgtatttttagcagagatggggttttaccatgttgtccaggctggtctcgaactcctgacctcgggtgatctgcctgcctcagcctcccaaagtgctgggattacaggtgtgagacaccatgcgcggctgcagatcccttctatacctgatgattgtttgggttgtgtctagtctgcagttatcaccaacactgcaatcgtaatcactgaagtatgtgtatcctgatttatataggtacacatctctcaaggatctgtaactggtagtggaattcatggatcttcaattcaaatgttgctcatggcagtgttaattataacaaccactttggtaaactacctgctattacctacaaaaccatgtgtaccttacacacgcaccatccattctactgtgtggagtaggccacggaaaagtacatgcacagttgatgaaaagacatgtatttaaatgtttatagcagcattatttgtaatagccaaaactggaaataaagcagagtgggtaagtaaatggtggtataggaattcaatggaattcaactataaataaaaaataatgaactgtatctacatgtaaaaaccttgatgaattttataaacacaaagttgagcaaaataatctaggcaaaaacatacttgtctgagcccatctctgtaacattcagaagtcagtatgacaagtcaggatggtggttacctgtgacaggagagaggctgttttgggaagggctcacttgggtcttctcagttgctggagttcactgtgataaatttaggatttgtttctttttagtgccgtgtatgtgtgtgtgtgtgtgtgtgtgtgtgtgtgtgtatataaacatttttttttttttttttttttttttgagatggagtctcactctgtcacccaggctggatgcctggctttttgtagtttagtagaaatgaggtttcagcatgtagctctggctgatctcaagctcctgaactcaggagtctttcctcctgtacaggagggaagacctttcctctactttctgagaattcaataattgagtccttgaaagaaattgacagtagtcagattaatgggagaaaaggtatacaaattagatatggacacagggacatcacatgaaagaaaagcgaatatcccagaacccagtgagattcagaagcttatgtaccctcttcttaggacagagggtataggtgattaggtaacttaggggagagtaaacagtttgggggaaagataaatggactgtcagaagaacaggtaacagccggtgacaaagtctgcgtgtgttatcaaggtctactctcctctcctgtgataggagccaatcttccctggttagtgagtttcctggggaggggattcatgacaattaagttccttttagataatctgtctttagataaggaagctcagagaaaacctctgcctgtatgagctgctccccacataacctcagttgaaagtaatcagcacaccaaagcatcatattttggggtggagatcctcccgcctcagtctctcaagtagctaggaccagaggcatgcaccatcatgcccggctactttttttttttttatttcttgcagagacagagtctcaccatgttgcctaggctggtctccaattcctgacctcaagtgatcctcctatctctgtctcccaaacagctgggattacaggcatgagttaccatgcccaggctaggggtggcatttcctgaactccttcagccctcttgggaaatgtgcaggcaggaagaaagaaaagaatacccttgtccacagccaggtcttgttgagcttatgcttggcagaatagaaccttacacccagccacgtgaaaactgggatgataaatgtctgcatgtctgacagaaggtttggcctctgattcagctgtggtgatttttccatctacttaactccaaattctattagctagtataaactctctattggactatgaacacagtaagtacacaatcatatgattattttatctattgacttaaatagaattgtgtatgaaggctgtactgaagttattcagggttgagtcaggaaaagctaaatttcaacctcttttaagaaaaatattgatgcctccaaatccatagtatatatgttgcttactagcttataaagggcccctggaagaaaggacatttccggtgttttatgtcaatcataggaaaataagctataagcttttttttaattctttgattctcaaaagtaggattgtggccaggcatggtggctcacacttgtacagcactttgggaggctgagatgggaagatcgctcaaggccaggagttcgagaccagcctgggtaacaaagcaagaccccatctctacaaaaagaaaaatgtatgattgcgtccccctaccactccccaacacttccctggctccacaccccagttcctctgctctcatttctgctgtgtcttactccatgaagctttcaaaactgcttttatagagtcctccttttcttttttataaatttattattgttgttgtttaattaaaagacaggatctcactctgttgtgcagttgtgcgatcactacagcctcaatctccaagcgatcctcccatctcagcctccccagtggctgggaccataggtgcataccaccatgcccagctaattttttttttttttgagacagagtctcgcactcttgcccaggctggagtgcagtggcgcgatctcggctcactgcaagctctgcctcccaggttcacgccattctctggcctcagcctcccgagtagcggtagcgcccgcaaccacacccggctaattttttgaatttttagtagaaatggagtttcactgtgttaggcaggatggtctcgatctcctgaccttgtgatccgcccgcctcggcctcccaaagtgctgggattacaggcctgagccaccgtgcccggcccactaatttttaaatctttttgtagagatgggatctaactatgttaaccaatctagtttcaaactcctggcatcaagcagtccttctgtccaaagtgctgagattgcaggcatgagccactgtgccaggcccctcattctttaaatagctactttagattctattgtaaggatattttaataattttccaacttttattatattgagtaggtgattcctttttaaattatatatgtaaatttttatttatatatttgaataatatgtttacatagttaaaaatcaaaatatacgaaaggcatacagtaagaagtcatctctttccacccgtaatgacaatatatccccttttgcctggcacagatgcacacataaattattgtcctgacatgattatgaataatcctgctttctctcagaagtgtgctagtttgaatgataaattatgcagacattctgcttgtatccctgcttcttcaccatgctgttatattccttccaattcagaggcaaatgtgatatcattgcctatgtgtcttccagaggaattttatttatattttgtaagtacatacatggattctggttttttttttgcactttttaacaaatagatgtatccatgctattttattttaaatttttactttgaaacaaccttaaacttacagaagttaaaagaatattagtagcaggtgtgctggctcacgggtataatcccagcaccgtgggaggctgagatgggtggattgcttgaggccaggagtttgagaccagcctgggtagcataatgagacctcctctctacagaaaaaaaaaatgtaaaagttagttgggtgtggtgttgcatgcctatcgtcccagccactcaggaggctgaggcaggaggatcgcttgggtacaggagttagaggctgcactagaccatgatcacaccactgcactccagcctgggtgacagagtgagaccctgttgcttaaaagaatattttaaaaaaaacctaccctttatccagattcacaaatactaatattttttcacattatttaatcaatttttctccttccctccctctttcatttctcccccttttctttttttttggagacatgatcttggtttgtcacccaggctggggtgcaatggcataatcatagctcaatggcatttcaaactcctgggttcaaagaaacctcctgcctgagcctccagaatagctgggactacagtcatatgctaccgtacctggctaatttttaaaattttttatagagacaggatcttgccatgttgcctaggctggtctcaaactcctaggctcaagtgatcctcccaccttgacatcccaaagtgttttgattacaggcatgagccaccaagcctggcctcctttccctcttttttttctccctctgtttcccactgcttataaagtttttaaattttttttttttttttttttttttttttttttttttttttttacttttgaccactttgagagaaggttgcagacatcatgtccctaatgcatttcctgagaaccgggatatacgtttggataatcatagtaaagatattaattcaggaaatataacatttatacaattattttatctaatctacaggccataacccagtttcttcatttgccccaataatgttttttatagctttttcatgttaaatatcttgtttggcactaagtatcttatcagtctgccataatgtttaatatctttcctctgaaatggttcctctgcctgcctttgcctttcatgtgtttgtgacttttgaagcatgcatgctaggtatgttacggaatgtcctcagcttgagtccatctgaagtgttcttaagactggattctactgatgctgttttggttggcacaacacggtgtttactattgtggtcgtcaaaatgatgttttatggctaaaccattctttcaacatttaatcatcaaggaaatataaatcaaaaccacaatgagatatcatctcatcccagttagaatttgctgttatcacaaagacataaaaataaatgctgatgaggatgcagatgacagggaactctcctatacttttggtgggaatgtgaattagtatagtcattatggaaaacagtatgcagagtcctcaaaaaactacaaatggaactaccctgtgaaccagcaattccactactgagtatttatccaaagttaaatcagtgtattgaagagagagctgcactcttgtgttcattgcagcattattcacgatagccaagatatggaatccaccgaagtgttcatcaacagacaaatggattaaaaaaatgtggtgcatatacacaatggaatactatttagccataaaaaaagaatgagatctggacattcacagcagcatggatggaactggaggacattatgttaaatgaaataagccaggcacagaaatataaatagcttaaaaagttgacctcatagaagtagagagtagaattgtgattaataatcacaattataaataatggtcagtatcaaaaaaaattgtcattctacagtgctgcagaacattagaacttgttttctctatctagctgtaattttccctcttttattttttttgaaacagggtcttgccctgtcacccaggcatggcataagcacggctcactgcagctcaaacaatcctcctgcctcagcttctggagtagctacaggcacatgccatcatgcctagctatttttttttaattttctataaaggtggggtcttgccatgttgcccaggctagtctcaaactcctggcctaaaacaatcttcctgccgtggtctcccaaagtgctaggattacaggtgtgagccatcactcccagctccaatttttagatactgaccccatttagatacatgacctcagaacacattccaagctcatgttgtatctctcttgtccccactattaaatcagctgtgttttttccaaggaatcctgatttctattgtggagaagcgtacttagaaaccaaggtcttggtgctactggtatgttattgcttttaggcccttccagatatacgggatataaagatatagctatatgtatgtgactatatgtattgtgtatatatgtatgtagctatatgtgtgtatgtgtatatatatcttcatgtatttatagtgatattttccatcccaatctacaccgcagggtttttccttgccttcctatttgtagagcttccttccacattaagaaccctctctcccagtgagtgtcaccccatttctgtttcatctctttccctactctcccccttgcctcctagggtcccctttcctctcatcagttgccagacaagaggagcatcatcatacacacatcatagatttaatattaaacttttaaaattttcagataaatgtaagcaggcttctgcagtgaaaggggccaggtctaggaagatggggaatacttgcaggcacctgggaagctcagggaagctgcaggtaccctgtcagttgggtgtcccctcatgagggtggcagactgtctccttgagttctgggtggcagaaatggcccagggccctgggctgagacccagccaactctctatggggctgccacacgacttcctaaaaaggcataaacacattttcttccaagtggagtccagcatattttattttcctgttgaatggtagacagcatgagagcagggtccatgtgatgatttttctgtcagtatcagtttctgcaagagcaaaaattacatatttttatttttcaaataaaatcaattgagacagtaacaaatttgctcaaagaatcaacctgaacacatgtacatctattatgtatcaataaaaaaatggccaggcacggtggctcacacctataatcccagcactttgggaggccaaggcgggtggatcacgaggtcaggagatcaagaccctcctggctaacgcggtgaaaccctgtctccaccaaaaatacaaaaaattctctgggcgtggtggcaggtgcctgtagtgacagggcgagcttgcagtgagccgagattgtgccactgcactccagcctgggtgacagagcgagactccatctcaaaaataaataaataaaaataataaatttttttctagataaaaaatataaaaattacaccacagtccaaaaaaaaaaaaaaaaaaactgttcaagactgatctttcatagtgattgggtctatgagtaaatgttaaatagatgatttattaggtttctttttatttcaatgatgagatggagaaatatattattttacatgagggcaaaaaatattttatgcatagatattttttattttgcctatgtccttaaattctcagaatatagattattgccttcagaaatctgtctaggttcacctataccttattagaactcagctttgctggctgtggtacacctgtaatcccagcactttgggagactgagaagggaggatcacctgagctcaggaatttgagaccggcctgggaaacatagggaaaccctgtctctacaaaaatacaaaaaaaaaaaaaaaaaaagtctgggtgcagtggctcacgcctgtaatcccagtaaatcccagtactttgggaggccgggccgggtggatcccgaggtcaggagttcaagaccagactggccaacatggtgaaaccccgtctctactaaaaataaaaaattagcagggcatggtggtgagcatctgtaagcccagctactcgggaggctgaggcaggagaattgcttgaacctgggaggtggaggttgcagcgagccaagattgtgccactgtactccagcttgggcgacaaagcaagagtctgtctcagaaaaaaaaaaaaaaaattagccaggcatggtggtgcacacctgtagtcccagctactcaagaggctgaggtggggagccctagtgggtgcagtgagccaagatcacaccactgcactccagcctgggcgacagagtgagactctgtctcaaaaaacaaaaaagtgagctttaataaattctataaaacttttttctagttgagagtacgttactacaagctaacttttaaaaaagtcatattatttgattactaggaactttgcaattagttttgcttcttctggtttttatttttgcctggcacaacatttccttccttggcccctgtctgtattaataatgctgccaggatatactgaatgattttattccagttttttctaccttaattatgttaaagaaaaacaaaagctgggtattagttatagtggtaaggacacattttaatcactaataactattgtaatcgtgaagaaagtccagcatgaactgaactcaactttggtgtgtacagaggtgactgggtattttaaaggaagaatgaagctgggtgtctactggacactggaatgaagctactgcagaggctgaggcagaaggattgcttgagccaggggtttgagaccagcctgggcaatacatcaagacctaggctgggcggggtgccacacgcttgtaatcctacactttgggaggtggaggggcggggggtgaatggcttgagttctggagttcgagaccagcctgggcaacatcgtgaaacactgtctctacaaaaatacaaaaattagcagggaatggtggcacatggctgtagtcccagctactcagggggctgaggtgggagaatcccttgaacttgaggagacagaggttgcagtgagccaagatctcaccactttactgtagcctgggtgacagagtgagaacctgtctcaaaaaaaaaaaaaaaaaaaaaaaaaaaaaagactttgcttcacccacaaagggaaaatcagggaataggagggagttgagttgtggggtagggtatgctcagttgagtcagagaagtaaaaatttaccaaaagtggtggttccatgtaaaacctacctgggattgctaactggtgctgtttgaagttagactatgaccctcgcacagaggccaggagacaggggccctatcttctgctgttggctggaacaaagagtaaattcatttgggaggcttcacttttttcaggcaggctatttaagggggatacagtcaaccaggggatatggccttgagatgctagaatctatgttagtattttgttcaaatatttataggccagggttaagactgactttgtttctttgttttttgagatggagttttgctcttgttgcccaggctgaagtgcaatggtgcgatcttggctcactgcaccctccgcctcctgggttcaagtgattctcctgcctcagcctcccgaggagctggcattacaggtgctcgccaccacgactggccaatttttgtactttagtagaaacggggtttcaccatgatgtccaggctggtcttgaactcctgacctcaggtgatccgcctgcctcagcctcctgaagtgctgggattccaggcatgagccactgtgcccagcgtaagacctagttgagaaggcagctcagaggaacctggctagagtttggtcaagaagactatctctgtcaatcataatgtgtattccaccaataagagtcattgagtctgtaaatgtttttttttttttcctttgagacagagtttcactcttgttgcccaggctggagtgcaatgacacaatctcggctcactgcaaccttggcctctcaggttcaagtggttctcttgcctcagcctccaaagtagctgggattacaggcatgtgccgccacacccagctaattttgtatttttagtagagatggggtttcacgatgttggttaggctggtctggaactcctgacctcaggtgacccacctgccgcagcctcccaaagtgctgggattacaggcgtgagcccccatgcctggccaagtctgtaatcttgattgaaagtttacttttgactgggcatggagctcatgcatgtaatcccagcgctttgggaggctggggcaggaggattacttgagtccaggagtttgagaccagcctgggcaacacagggagacctcttctctacaaaaaataaaattagccgggcttggaggtgcgtgctgatagtcctagctacttgacagactgaagtgtgaggatcacttgagcctgggaagttgaggctgcagttagccaagatccatgccactgtgctctagcctgggcgacagaatgagaccctgtctcaaaaaaacaaaaagaaaagaaaagttgactttttgccagctgttaggaaaacatctgtggctctggagggcggctggtttaaagaaaaaaaaaaacaatcagacatacctgatatctacaagaggataatgagcttagtatggtgtgtgtaggagcctagaggagagaggctgggaggggattcttggggaaaacggtggttgagttggggttcagaggcaagcccctaggtcttaggctgggcacggtggctcatgcctgtaatcccagcacttcaggatgctgaggtgggcggatcacctgaggtcaggagttcgagaccaggctggacatcatgatgaaaccctgtttctactaaaaatagaggagaatttgatggccattcacagtcaagggaactgaacacatcaaagggattgccagaagggcagaagtcctgacttacaggtataaggagaaacagaagaggagacaaggtgtggggtctaccaggtgggcaggcccattgagtagagggtacatggcattcattgaaggattttcatcaaggcagtcttctggtaagatacggggaagtccacaggctaattggaaaacagaaagaatgagatcatggagacaaatttagggactgactccgtctgtattaatttataccaggggtcagccaagtgcaacctgtggctaaatttggactgctatgcatacatgtatggcttgtgagctaacaaagttttttatggttttaaatacttgagccaggtgcggtggctcacacctgtaatcccatcactttgggaggccgaggcgggcgaatcacctgagtttgggagttcgagaccagcctggccaacatggtgaaaccccgtctctattaaaaatacaaaaattagctgggtgtggtggtgcatgcctgtagtcccagctactcaggaggctgaggcaggagaatcatttgaacctgggaggcggaggttgcagtgagccgagatcatgccattgcactctagcctgggcaacagagtgagactctgtctcaaaaaataaaataaataaatacttgaaaaaagcaaaagaatagcatttaataaaaattatataagattcaaatttcacggtccataagtgaagttttattggaatacactcatgcccacttgtttacatattgtctgtgactgctttcacacttcacactacaaaggttgagtagttgtgagtgatcgtcctcaaagcctaaaatatttactctctggctctcctctctacagaaaaaggctgctgatctctgcctgattcattgattgattattatttgaaatggggtttcactctgtcatccaggctataaagcagtggcgtcatctcagctcactgcaacctccacccgccgggctcaagcaatcctatctcagccttctgagtagctggaagcagaggcgtgtgcctccgctcccagctaatcttttgtatttttggtagagacggggtttcaccatatttcccaggctggtcttaaactcctgagctcaagtgatctgcctgcctcagcctcccaaagtgctgggattataggcatgagccaccgtgcttggctgacctctgatttatatggccagatgggggcaggtactcagttgcttgtgcatattttgttgggagatcacaagttagcaagataaaagtgctttcatcacagaggtttcagtctagtagaagttaaatttttgtgccgggttcagtggctcacacctgtaatcacagcactttgggaggccgttgcaggccggttgcctgacctcaggagttcgagaccagcctgggcaacacagtcaaaccccatctctactaaaatacaaaaatctagctgggcatggcagcatgcccgtatagtcccagctactcgtgaggctgaggcaggagaattgcctgaacccgggaggttgaggttgcagtgagccgagatcatgccgctacactccagcatgggcaacagagcgagactttgtctccaaaaaaaaaaaagttcgatttttgtttaataggtgagatcatatgaaacataaatataagtactgatgtagggattgtgctttgtgaatgggtctctgcctgcaaaacattcctgagaagctttctgaagggttcaagctgagaacagaaggatggagaaagagattctgtaagttaggaggcaagaatctgagctaagatttggatgtgacaggaccatgagtggatagggaatgttttgtttcttgagtgggaagtgggaagcattttgggaacaaggtaaggaagagagaggaggctgcagtgtttttaaggagtcctgcccacgccaagaagtctggactggaggtcatttgctttaaacatgtcatctcaagcatgtgtgatctatttggagcaaatataatcaagggaagttttaaacaggagagttttcagagcagtggagtctgaaaagttgccctaaaataaggttgagcataagaaagtccttcttgcttctggaaaaagtggactatgggtgctcactctttggggccagacagagaagaattaaaaatcatgggctgggtgcggtggctcacccctgtaatcccagtactttgggaggccaaggtgggtggatcacgaggtcagttcaagaccagcctggccaacatagtgaaaaccacgtctctactaaaaatacaaaaattagctgggcatggtagcgcatgcctgaagtcccagctacttgagaggctgaggcaggagaatcacttgaacccaggaggcggaggttgtggtaagccgagatcatgccactgcactcccgcctgggcaacagagcaagactctgtctcaaaaaaaaaaaaaaattgtgttatttctcccttttgcacctaatctcccactgaagatgactgcaactttcctgtgaattctgaacctgctgccaaaagatacttctttatattccatgattttgtgtaaaactttgtggtgagaattagagaaagcttaatttgctgcttggcatccagaattaggaggccaagttaggctcccatgttaattttcagaaagcccatgttcctgatatctggtagggatggcggtgctgaactgtgaaggtgttggaaaccagaattttggcagaaacggagtcagatttgaacatggtacaaatttggaccaagggcctagtgatagttaggtcaggaaattggggactgtattggtccattcctgcactgctataaagaactacccgagcctgggtaatttataaagaaaagaggtttaattggctaatggttctgaaggctctaaaggaatcatggctggggagtccctaagaaacttgcatcatggcagaaggcagaggggagtcaggcacatctttacatggcagaagcaggagagagagagcaaggggaggaggttccacacactttcagacaaccagatcttgtgatatatcacaagaagagcaccaaaggggaaatccacccctgtgatctagtcacatcccaccaggccccacgtccaacattggggattacaatttgacatgaaatttggatgggggcacagactcaaaccacatcagggaccaaagaaatattttacttattttcagttatcaatggaatttactgctgatgagaaataaatgtatcttgccagtaacttataaagtaataaaaccggccaggtgcgatggctcacgtgtgtaatcccagcactttgggaggctgaggtaggtggatcatgaggtcaggagatcgagacaatcctggccaacgtggtgaaactctctctactaaacatacaaaaattagctgggcatggtggtgcgtgcctctaattccagctacttgggaggctgaggcaggagaatcacttgaaccagggagccggagattgcagcaagacgagatcatgccacaccactccagcctggcgacagagcgagactccgtctaaaacaaacaaacaaacaaaaaaatcaaaacaatttccctagaaatgtataattattgacactttttagtatttaaaaaattttcagtgataccctgtatttacaaaacaaaacaaaacaaaaaaaacgaaaaagcaagacaaaaacaaaacaggcatggtgatgtgcacctgtagtcccagctactcaggaggctgaggtgggaggactgcttgagcctaagagttcaagccatgatctcaccactgtactctagcctggatgacagagcaagactgtctctaaaaatttttttaattaaaaaaaaatttcatcttgacttgcttttcatgtgaatctagtgtatttgctactttttgataatgctttgcactttttaaattgtaaaaacattacataaaattttcatcttacccgtttcaggggcactaagtgcattcacattgatgtgcaaccatcaccactgtctagctctagaactttttgtcttacaaaactgaaaattgcccattaaataataactccgtttcctcctccccacaccccatcccctggcaaccaccattctacttcctgtctccatgacatttgattagtctggatatctcgtataaatggaatcatacagtatttgtccttttgtgacaggcttatttcattctgtgtagtgtttccaaaattcatccatgttgtagcatgcatcagaatgtacttcctttttgaggttgaatgatactccattgcatgtatgcattacattttatttattaatccatcagtggatgtttaggttgcttctgccttttgggtaatgcaaataatgctgctatgaacatgggtgtgcagatacctctttgagtttctgcttctaattcgttttttttttttttgagctggagccttgctctttcgcccaggctggagtccagtgccacgccatgatctcggctcactgcaacctccacctcccaggttcaagcgattttcgcttgattctcctgcctcagcctctcaagtagctggaattacaggctcaaaccaacacaccaggcgaactttttatatttttggtagattgggggtttcaccatgttggccaggcaggtctcaaactcttgaactcaagtgatccacccaccttggcctcccaaagtgctggtattacaggtgtgagccaccatgcctggccttctgcttctaattcttttagatataaccttgaagtgacagtgctaaatctagcactgtctggtcttgaactcctgacctcaagtgatctgcctgccttggcctccgaaagtgctgggattacatgtgtgagccaccatgcctggccaattgaagatttttattacttacattttcccagaaagggggcatgccacactacaccacatcacgtgaggagcactaggttttggtcaggaggcagaagataggagtgaagggaaaaatctagggcaaagcctttactggggactccaagggaaacacagggcaggtttgagcataggatgggttagtttaaataattctggttggctttgggctacagggatggtctctagtgacttggtttgtgccctgggtatatagaatatgggaaatagtggccagcgagagttagctaaggagttggctgggctacagactgggattggttgtttggcatatgaaagacatgcttatagacaaattgttattatattcgagaattagctagctttgggaaggacattctctcccatgatttgcaaggccctcaaaagccagagcaacaaaaatacagaaaataagatatagttaatataattggcttggtgatgaacggatcccaaatagtcaaacacagaagctaagaaaacccagaacacatggtaattcttctgttgcattttttttaggaaaccacatagtgttttgcatagtggctgtaaaaattttccattcctaccaacattatacaaggttttcaattcctctggtcttcaccatgacttacgttctgtttcttctgtgttttatagtagccatccaaatgggtgtgaagtggtatctcactgtgattttgattttgattttgatttccctgatgattagtgatgctgagcatctttggatgtgcttcttggccatttgtatgtctttggagaattcttattaagacgtttgcccatttttatgtatgtatatatgtatgtatttatttattgagatggagtctctttctgttgcccaggctggtgtgcaatggcccaatctcggctcactgcaacctccgtctcctgggatcaagcaattctcctgcctcaacctcatgagtagctgagattacagatgtgcaccaccatgcctggtcaatttttgtatctttagtagagacggggtttcaccgtgttaaccacgctggtctcgaactcctgacttcgaatgatccacccacctcggcctcccaaagtactgggattacaggcgtgagccgctgcacctggcttggcccattttaaaatcaggttttttttttttttaaagttgattatagaattcttctttttttttttttctttttgatacagagtctcactctatcgctcaggctggagtacaatggtgtgatcttggctcactgcaacctccaccttccgggttcaagcaattctcttgcttcagcctcacaagtaactgggattacagacgtgtaccaccatgcccagctaatttttgtatttttattagagatgtgatttcaccatgttggccaggctggtctcaaaccattggcctcctgtgattcactcaccttggcctccccaaatgctaggcttacaggcatgagccactgtgcctggctgaggagtcttatatctattcggactattaacatcttatcaaatatatgatttgcaaatattttctcccattctgtgtgttgccttttcactctgttgattgtgtcctttgatgcacagaaggttttgattttgatatactccagtttatctatttttgtgtttccttagcttttggtgttgtagtcaagaaatcattgccaaatgcaatgttatgaagcgttttttcctgacagttttatagctttaggtcttatatttaggtctctgatccatttcaagttcatttttgtatatgatgtaaggaaagggtccaacttcattcttttgcatgtggatatccagttttcccagtaccacgtgttgaaaaggctgtcctttccccattgaaggtcttggcacaattgttgaaaatcatttgaccatatggaagagtttatttctgggatctctattctattccagttgtctatgttttgcattctttttaaaaaatatttttagtctttacatttcagaatcagtatttcaaatgtgacttgtaggactacgtgcagtgaggaagattgttaatcatcctattctgaccaggagttctgacaactttggtgctgtaggcggtgtctaaggcaggtgtcagcaaattttcctctaaaggagctgtgtgtgtgtgtgtgtgtttgtgtgtgtgagtgaaaaagaggtgagatttattttaaatttattttaagaaattggcttacatgatggtacagtcttgcaagtcaaaaatctgcagactaggctggcagtctggagacccagggaagagttgcggtgttaagtgttaagtctgaaactagtctgaaggcagaattccctctcttcctcaagagatcttaatctgttttcttttgtttttgtttttgttttgagacagagtctcacagcccaggctggagtgcagtggcacaatcttggctcgctgcaaccttcgcctcccaggttcaagcgactctcctacctcagcctcctgagtagctgagaccacaggtgcacactaccatgcctggctaatttttgtatttttagtagatacggggttttaacatgttggctaggctggtcttgaactcctgagctcaggtgatccatctgccttggcctcccaaagtgctgggattataggcgtgagccactgcacccggcctaacaatgacattttatatacacacaggcacatacacaaacctatttataaaagatgaaatactcaagacaattacagttctgatttctgtaactggtcaggtggtcacagctcatatttgtaattacctttgtctactactcattatgtatttccattgtcctcagcaagcaccacggctggttgtgattatttatctggtggggtgacccaaacctttgatttctgaagggtctaggccagtcatagtcctgcctgaatttcgttgttagagttttccatgggctttggtcacagagcttggttaatcctgaaataccctaagggatcccttgtacttcatatgtattcttccttacttcctttgtgaagcagaagtccagtttctccttggtaatcaggatgagtggcactagccagcacaacaattcccttctttgttgattcaaaggcatgaggagcctaaaagggttagatggcagttttttgtttttatttatttatttatttatttattttttagacagagtctcactctgtcacccaggctgcagtgcagtggcgcaatctcagctcactgcaacctctgctgcccggggttcaaacaattcttctgcctcagcctccccagtagttgggattacaggtgcctgccactgtgcccagctaatttttgtattttcagtagagatggggtttcaccatcttggccaggctggtcttgaactcctgacctcgtgatccacccaccttggcctcccaaagtgctgggattacaggcatgagccaccgtgcccggcctagatggcagtcctaacttctacttcagtccaattactgctatatctactgatggaaatattcctgctgttggaactaagactgccagaccagaagagtatgagatcatggggacaggaaacacaaattttgctagttggtcaactagggatatttgtggagggctgccactcccatttctatcttttggtttctagacttgtcaaccccgactatgggagaaacagcaatatattggacactgactcagacagtatacagcctcctgaaaagccttaccccagtcctgtaaagtattaccaaatagctggtactgtaactgaatcttcaaaaggcctttccaccattctatgaaatcatctgccttaggatggcggggaacatggtaagaccaccaaattccatgagcatgggcccattgctgcatttcctttgctatgaagtgagttccttggtcagaagcgatgttgtttggaatactatgatagtggttaaggcattttgtgattttacagagggaacttttgacagaagcattgcatgcagtgtaagcaaatctgtatccagagtaagcatctgttctagtcaggacaaaacactggcccttccatgatggaggggattcagtgtaatcaacctgccaccaggtagctacctgatcactgtggggaatggtaccatagtggagactcagtgttggtctctgctgagggtagattgggcactcagtggtggccatagttaggttggtcttggtgaatgggagttcatgtggccaaacccatgcgtaaccttcatccctgccatcatggccacttcgtttataatcccattgggcaatgacagaaaaatgagcctgactgtacatatgaaacaggtcaccctatccactttgtcataaaaatcctcctctgctgagtgggcattcacatggccacaaatgtctttacctttttttttttttggggctgatttagaggggtctatctataagtccatctatctcttcccaaggcttccttgtcaccaattttccaatcatgctccttccacattactgaccagccaaaccattgaccacggcctataaattggtatataattgtatatctggccatatgtccttccaaacaaaataaacaaccaggaacactgtcccaagctttacccactgggaggatttgtcttcaccactcttcttcagggaggtcttcagaaaggctctgtagtgcagcagttgtccacttctgggtggtatgtgcatgttttgtagaaccatctgtaaaccaggcctgagtcttctctttttccatcatctgattgaagggaaccccccatgagccataggtgcagctgggatagagaaagcagtgtagcaggagtgggggccgtggacatttgagccacttcttcatgtgacttagttgtgtcttcagatcatgttctggctgtgtaggcttaactttacagctgggctggtaagataacacccagttcatgaagggcagcttaggttacatggtaacttggtgtcctatggttaagcctttagtctccactaatgcccagtagcaggccaacagctgtttctcaaaaggagggtagttaactacagaggatagcagggctttgctccaatatcctaaaggcctatgctgcaacttaccaatgggggcctgcaaaaagctccaaaagacattactgtctgctactgacacttcaagcattattggttcttttttttttaatttttttatttttcgagacagggtctcgccctgtttcccaggctggagtgcagtggcatgatcctggctcactgcagccgctgtctcccaggttcaagcaattctcatgcctcagcctcctgagtagctgggattacaggggtgcactaccatactcagctaatttttgtatttttagtagagacggggtttcaccacgttgactaggctggtcttgaactcctgacctcaagtgatctatctgcctcagcctcccagagtgctgggattacaggcatgagccaccacacctggctgcatcattggttcttgcagaatcatgtgaccatagaggcagagaaatttatgttgcagcctggacctgttgcagaagcttctgttgttttgggatccactcaaaactacagcttttcaggtcattaatgtagcacatgagctgggtgtttgaatccctgagctaattttccccctactttgttcagtgaaattaggtgcaactagacagtctcattatacttgttagtttgacaaaatgtttgaaggtatcatacatgttaacccagaaccttgccttttatacttatttaatttaaagtatctgggctgggcgttgtgggatcccagcactttgggaggccaaggtgggtggatcacctgaggtcaggagttcgagagtggcctggccaacatggtgaaatcccatctgtactaaaaatacaaaaagcaattagctagtgttcttttgattactcgtaattaatgcctttaaatctagttagtttagagtaccaatttcagaaaccaaccccagaactaattcagaaaatttattcttaagatctggttcaggtagagctactcttgctaccgaaatctgtgtgtgttagggttctccagaaaaacaaaatgaactaacaggatgtgtatagtctcagtctctgtttctctttctcagaattggtcatgtggttatggaggctggctagtccaaaatcttcagagcaggctatggattcagggaagagttgatgttgtagctctagaccaagggcagtctggagagaatttcatcttctttttctttggtttgttttctcttatgggtttcaattgaatggatgaggtccacccatattaaagaaggtatctgctttactcaaagtctactgatttaaatgttaatcccatctcaaaacatgccatcgtggcaccatccaggttaatgtttgaccaaatatctgggtaccatggcctagccccattgacacataagatcactatcacagtcagataacaaatgtttagctttgtgggtcatatggtttatgttacaactactcaactgtgtggttgtagtcatagacaatacataaacaaatggctgtggctgtgttccaagaacactttatttatagatactaaaatttgaacttcatataatgttcacatcataaaataaacttttccttggatcctttcctcctttcctcctctccccctttcccccacccaccatgtaaaaaaaaaaaaaaaaaaaaaaagtaccacagccagttgcaatggtaggtacctgtgcatatcactatgcctgtaatcccacctacttgagaggctgaggcaggaggatcacttgagcccaggactgcaaggttatattgtgctataattaaacctgtgatcgtgccactgcactccagcctgtgcaatatagaaaggccccatctctttaaaaaaaaaatatacaggcagcaggcaggatttggcatagtttgctgaccgtcaagggctctcttttctaaaacataggcatggtaagaatatgtgcaaaggccatgggtgaagagctttttattttgttgcttgtgttccagttggtgcattctcaagagtaggtactttcttttcttgttcattctcttcctgagcctatcttgggattttctaagaaggttgctattagtctagtctttttccagctgctccctagattgaggcgggagaggagaaattcagcaaagatttctctctcctcatcaaggctgtcccttgcctgctttcctgtgggacagatggtgcatgtaggcaaaaggctggaacatgttggctgctcctgttacttggtgctttgagcagaaaggcctgttgggttagttcctgggctccagtgctcaatgtgtgtgtgtcctgttttgtgtttttacccatctttctgccttggctttaggtttatatgtttgcatttataaaaacttcttatggaatagaattataatgaagaggagcagcaaagagttgtggttgagagctggcagtactggaatcagaatgcttggcttgaatctgggctcaaatgcttgagagctgtgtgactttgagtacggttcttttcttttctgggcatcagtttcctaatctgtaaaagggatggaaatagggccaggcatggttccttatgcctgtaatcccaggtactcagaaggctgaggtgggaggatagcttcagcctaggaggtcgaggctgcagtgacccatgattgtgccactgcactctagcctgggtaacagagtgagaccctgtctctaaaaaaaataaaaagaaaagatggaaatgaaatagtaactcacacggtttttttgttttgttttgtttttttgagacgaagtcttggaatctcactctatcacccagactagagtgcagtgatgtaatcatggctcgttgtagccttgacttcctgtgctcaagcaattttcctgtcccaacttcctgagtggctggagctacaggcacgtgctaccatgcccagctaatttttgtatttttagtagagatggggtctccctatgttatgcaggctagtctctaactccaaggctcaggtgatccctctgctcagcctcccaaaatattgggattataggcatgagcctgcagtggccatcacatggtttttattttttgttttttatttatttttaattttttatggatctagtcctgaatccagaacatgatttttaaatgaactaatgttaaagtacttagaaaagtatctgctgcatagtaaggatatgtggttgtacaataaataaaaataaagagagctgctcacatagagtgcagatttcaaaccatctagtctttctcgttttattacattgaatttctgcttctgaatttttaattttgttataagaaggatgttagtccctctaaagtatcatttccaatattttgtttatgttccataaattttaaggttattttacttcaaattattttataatgtatatgccttttatatttgttttagttatatcaaaatgcagctttcaaaaatattttagtgtgtataattatttcagattactattagtagaagtgcttttttaaaagacaaatattatatttaagagaccctgccacaaaagtactcctcatggaagggaagatggactggggatgatgtggcagttatacagggaaaacttcacattattttgtatttaaaacataacctgaggctgggtgcggtggctcacgcctgtaatcccagcactttgggaggcagaggcaagtggatcacgaggtcaggagttcaagaccagcctgcccactatggtgaatccccgtctctactaaaaatacaaaaattagctgggcatggtgacatgcacctgtagtcccagctgcttgggaggctgaggtagagaattgcctgaacccgggaggcggaggttgcagtgagctgagatcgtgctattgcactccagcctgggcaacagagtgagactctgtctcaaaaagaaaaaaaccaaaacagaaaaacataacctaattttatattttgttttgtcatacagttgtatttgttttaaaatatctttccaccccttccaaaagtattttatccaagtagcagcacatcttatttccatgtctgggttggactttatttatacttgtctgaaactaaggaaaaagaaagtaatttatatcagttaaaagacctctacttctcaataagttagggggcggaggaatgggtctcaatctaccactcacttttctgctagaatttttttttatattgatacctcccattctttttttattttattttatttattattattatactttaagttttagggtacatgtgcacaatgtgcagattagttacataggtatacatgtgccatgctgtagaatttcttaatgttgcatcagtgtttcacaatgtaatcgaaaactcaaaatagcaatcttccttttttattttattttattttatttatgttttgagatggagtctcactctgtcgctcaggctggacagtgcagtggcatgatcttggctcactgcaacctccagctcccaggttcgagtgattctcctgcctcagcctcctgagtagctgggactacagatgcatgccaccatgcccagttaatttttgtatttttagtatagacggggtttcatcatgttggccaggatggtctgaatctcctgacctcgtgatctgcccgcctcggcttcccaaagtgctgggattacaggtgtgagccaccgcacctggcctcagaacagtttatatttaaaaattatttcaaagataggagagagttcccatgtgtctcatatgtttcccctattaacatgttacgcttgtttcattgatgtaccaatattggtacatttttattaactgaaatttatactttatccagatgtctttggtttttctaaaataccctttttctgttccaggatctcacccaggaaatcacagtacagctagtactcatgtgtctcaaggttgttcttggttgtgacattttctcactttgttttgatgaccttgacagttttggggattactggtcgaatgtttgtagaatgtccctcaattagggtttttaaaaactgatttataattcacatagtataaaatttacccttttaaaatatataattcagtgcttttgagtatattcacaacgtttcccaaccatcctatggttggaaaattagataacctactaattccacaaaatccagaatattttgatcatcccagaaagaaacctcataaccaacagcaattactctcctttcactcctctcccatcccctgaaaatcactaatctgctttctgtctatatggatttgcctattctttttttttttttttttttttttttttttgagatagagtctcactctctcacctaggctggagtgcagtggcgcaatctcggctcattgcaacctccgtctcctgggttcaagtgatcctcctgcctcagcctcctgagtagctgggattgcaggcacgtgccaccacacccggctattttttgtatttttagtagagacaaggttttgccatgtcggccaggctggtcttgaactcctgaccttaggtgatccacctgcctcggcctcccaaagtgctgggattacaggcgtgagccaccacacttggcctggatttgccaatccttaacagaacatataaaaagaaccataaaaacgcctgacatgttgcctcatgtctgcaatcccagtactttgggaggccaaagtgggatgattttttgagtgtaggagttggagacctctctgggcaacatagttagaccaggtctctacaaaaaaataaaaaaattacctgggcatggtggtgcatgcctgtagtcccagctactaaggaagctgaggtgggaggattacttgagcccaggagatggaggctgcagtaagccatgattgtgccaatgcactccagcctgggtgacagagtgacactctatctcaaaacaaacaaacaaaaaaccccataatatgtggcctttttctgtctagctgctttcactcagcataatgttgtcagggttcttccatgttgtttcatgaatcaacactccattcctttttatagcagaatgatattccattgtaccatgccatagttgtttcctttttcttttctttctttctttttttttttggagaacgggtctcactctgttgcccaggctaaagtgcaatggtgtaatcatagttcactgcagcctcaacctccctggctcaagcagtcctcccacctcagtttgggtagctgggactagaggtgcacaccactatgcctaactaattaaaaaaaaatttttagtagaaatggagtcttgctatcagggagatcttggactcctgagttcaagcaatcctctcgccttggcttccaaaagtgttgggactgcaggcatgagccattgcacctggcctcacattttgtttattcattcatcagttgatgagcatttgagttgtttccagtttttaactttttttttttttgagacggagtctcactctgtcacccaggctggagtgcaatggcagggtcttggctcactgcaacctccgcctcctgggttcaagcgattctcccacctcagcctcccaagtagctgggactacaggtgcgtgccctcacacccggctaatttttgtatttttagtagagatggggtttcactgtgttggccaggctggtctcgaactcctgacctcgtgatcagccagcctcagcctcctaaagtgctgggattacagtcatgagccaccaccagttttttagctattataaataaggctgctatgaaaatgcatatacatgtttttgcattaagatatgttctcatttcttttttttttttttttttttttggtgacaggttttgctccatcacccaggcggagtgcagtggtgccatcacagcttactgcagtctccacctctcaggctcaagtgattctcctacctcagcctcccgagtagctgggaccagaggtgtgcaacaccacatttggcttttttattttttattttgtagagacgagtcttgctatgttgcccaggctggtctcgaactcctggattcaagcgatctgcctgcctcagcctcccaaaggattgggattacaggcttgagcccctgtgcccggcccctatgttttccttttttttttttttaaatttgaaacggagtcctgctctgtcgcccaggctggagtgcagtggtgcaatctccctcaccgcgacctctgcctcccgggctcaagggagtctttagtctcagtcccaagcagctgggactgcaggcgcccgccaccatgcctggctaatttttgtattttttagtagagacagagttttaccatgttggtcaggctgatcacgaacctcctgatctcaggtgatccacctgtctcggcctcccaaagtgctgatattacaggcgtgtgaaccaccgtgcctggccgttttcatttctttgtgatctgcttaggagtagaattgtaggtcatatggtaacttcagggttaacatttgtaagcattgccaaactcttccactgtggctgtgctgtttcacatcccaatcagcagtgttagagggttccaatttctccacctcctccacaacccttgtcattgtctttttaattctagccccaagtggcatctcattgtggttttcatttgtacttctctaatgacttaacgattgtgtcttttcatgtgcttattggccattggtatttaagaactattttaatcctttgcccattaaaaaaaaatgtttttgtccttttattgttgaatagtaacacttttttttttttttgagacagtctcactctattacccaggctagagtgcagtggcgtgatctgggcttactgcaatctctgcctcctgggttcaagggattctcctgcctcagcctcccgagtagctgggactacagacatgtgccaccatgcccagctaattttcatacttctaataaagacggggtttcaccacgttggccagaatagtctcgaactgctggcctcaagtgatctgcctgcctcagtctcccaaagtgctgggattacacttatgagtcactgcgcccagccaagtactaacacttctttatacattctggatactacactcctagtagctttatgtttagcaaatattttctcccattctcttggctgtcttttcactttcttaatgtcccttgaatcgaaaacttttatgtaactgtgatgaagttcagtttatttattatttttggttgcttttgttttaggtgtcatatctaagaaactgttgcctaattcaaggttacacggatttatatatatacacacatatatttatacatgtatacataagtatacatggaatatatgtgtaaaatatacacatacacaaatgttatatatcacatttatacataggtatatatgtgtacctgtatacatatataacatgtatatatatgttctataacaagtgacttatattttattgatctattttgagttaatttttgtacatggtatgatgcaagggttctgattagtttttctagtctcctttgtctattctgtacagaatagttttattgcagttttagtgtcctttaagtacataaccttaagtgtttggcttggggataaatgtagactttgggaaaattgaattgttgggagacctatcagggtctactagcatgtcatagtggagtttagtggcaatgtctccttctctgtatcttcactccccagttgtaggatatgttgaatcagacctattattaactaacataaaatataagtgagcctaatggcagttctctttagattttctgtaaagcccaggacacccattgtgacctctcagactccaaagcgaatttcctaatggagtagaacaaacaggaaattatgaggaaaggcagtcagagtttgaaaagagaacacaccagaaacaatggaagataggtccaagaaactagataagtgcgagttgagaattgaatataattttatttaattttaataatactttaattgtaaaagtaattcataatcactgcaaaaagtaccaagcactgtaaaaattaaaaatacaaaacaatctcaaattgtgacagccaagagaaacctaaagaaacatgattataatgtttgtggcatgtaagtttggtgtccacaatggaaaaaggatattaggaaaaaaaagaaatataagatatagaaattagttaaaacaatgagaataaaaaatgaacacccaattcctgctcctagaagaagtagtactctaacatttggtgaagttctaagagccaacatttttacccagcttatactaggacctgttctaaatagtattttagctcatttaattgttaagccattgtataaagtaaacagaatcccttcttttgttacagattaggaatttaatgcacagagggttagataacttgctcaaagtaacattgtggtcaagagtcaaagctagaatttgaatcaaaagagcctgagtccaaaggcatggttttcatcactggactataatggtgtgtattctttcataattttttcagtgtaaaactgaacatacagtatgcttttattttatttatttttttgagatggagtcttgccctgtcaccaggctggagtgcagtggtgtgatctcagctcactgcaacctccgcctcccacgttcaagcaattctcctgcctcagcctcccgagtagctaagattacaggcatgtgccatcacgcccagctaatttttctgttttttgtagagatgggtttcaccatgttggccaggatggtctcgatctcctgacctcgtgatctgcccacctcggcctcccaaagtgctgggaatacaggcgtaagccactgtgcccagcctacattttatttttcgattgactcccgtgatcagagtcaacttcccatgttattttatgtgaatatgtatcaatgaactattagaaattgcaatgtttttgtaggtcaaaacaattcaatattgacaattttatatgattcagcctaatacatcattttttccatcagccatattgcatgttattatttatatatacgtttatttagttagcctatctgttctctgtgaggaacattacacagtttctgagattttgttacgatagaagtcagcattgataagcctctgcgcacctgttttaatgtaggatcattgggaactgagcagtagcttacagggcttgggaggggatttaaccatttagtcaacctccactcacatcaccctcccttcttcgataatgggcaattgagaaagggcaaatgtgtgtaaaaactatgcagatgcagtttcaggattattttcttcttttctgcagtgtcttttcccaagctacatcagcgtctaaattttggagttactgatgcttccgttatttctgcagatagaatattatgtcgtaaataatgtttacttgtccattagtattatataaaagtgcctgtttctccccactccagctatcattgattattggtaaaaattttaatgtatccaattctaataggcaaagaaaggctctcctacttagatcttaggtgggggtctaagttcatatttttgttttacaaaaattgaatagccagtgtttttgagttgaatgatctatccattccgtataggagagtttaattatattgtgattttgggggagataattttcacaatttaccccctcaaaatgtagaaagtagaaaaagggtagaaaaatcgcaccaaatttgaacaatgtagcatgcttttagagttagggatattttcttttggaaggatttcaagtctggcgtatttgcattgattgtggttatggcgcatttaacttttccaaaccagcttttttgtaccgcacataggaagacctgagggtgagtgtaaattaggattgtttggccagtggtgtgtgcaaaaatttattgtagaaccaagaattatttctttagtattttacacattttaaaaaacaggtagacatgtccattgatcccaggttgcttatggtttctagaggccccctctcattgcaacagtgctgtggggccctaggggtccagtagccccctccccccaggtcattccggtgagggagggagctgggacccctgcactgcggcaaacaagcacgcctgcgcggccgcagaggcaggctggcgcgcatgctcaggcggggatgtgtgcgaagcctgccgctgctgcagcgagtctggcgcagagtggagcggccgccggagatgcctgacgcatctgtctgaggagcggtcagtgacgcgatggagcgggcaaggtcagctgtgccggtggcttctctcaagagacagcctggggagcggccacttttattcatcagatattccaagtttttaggacttggagtactgaataaacggaatttgggccctaaagtcctttgttctggagaaccagatccggaatgttcagaggcttgctgttgtgccgttctgccccgatggtatcctgtccgctcgcattggggcgcgtcccccatccgcccccaactgtggtgtcgcgacaggtcctattgcgggtgtctgcggtgggaagggcggtggtgactgggagcatgcggggtaaccgcagtgggcaagggacatgggtggaggtgggtacatcagggtgattgcagttccgtgtggcgagggtacgtggggggaccagtgcatagggattttaggcggaggtaggtatattggagtgattgtggcggggcgaaggtacgtgaagtgatcggtatttagggggtgttgagcgcaggtaggtgtataatagtgaccactgcgtggtggagcagggtacgtggggcgactggggggggaattcgtcgcagtgaccgaggcgaggaggctatggcagtggaccagggggatgagtcggtgtgacagtggtgggggttgtgttggtggtcgcggcgcggggagagtccgtaggaagtggctgggaggtagggggaaggcggcgacagtgggtattggcggcggtgggcattggcagcgggtaggcatggcggtggtggactttggcggcggtaggcatggcggcggtgggcatggcatggaggcggtgggcatggcggccgcggggcctgtcgctgtccggagtgactaagggacgctgaatgattgctgtgtagaggagggggcatcagaaggggcagtagcacagtccgcagcctttaattttcctgtgacctgcgatggtcatctggtttgcctactgtggtggtggtgcttttttattaaaactgcgcaatgcctacactgccgcaggggctgcagaaatgcgtggaatccttgcgtaccctttaggaaccctcgctttagaggctatggcataagaagactggaatgatgtgcagaacttgcatttacagatcttttgactgataggccaggtgatgcctgggggttacttttttttcattgtttctctctgttgggaaccaggtcttggaaggctatgtcgaaataacctgggggtctgtgttgcgtcactgccattgtgcagctccttcaagatggccgccgctgcagcggcttagatctgcgcaagcgcttcagcgggggggtggccgcttcctccctgtagagccgccagtggggagggggcaggtggtgtgtgttcagcttctgctgtttcggagtttcagccgtaccctctttagggtgcagtggtaaggagaggaagccggccaaggtgggcggctgccccctccccaaagtgctgcttgggaaaggatgcaggttgcgcagacgcagcagaggtgacagtcgcctccgcttgcagtggggcgagacgtggggcaggggagcgagggcttacgcagcttttgcctggaaggaatggcagccctccccttcacctggctgatacagcagctgttcctttccggttgtggcgcagtagaggggggaggagggagatgggttggcgcaggctccgcctagcaagcttggcagccaccccttacccacggtgcagcagtagaggactggaggggaatgtggctagaggccaggcatttgtaccacctccgcctgtgtgggatggcagctgcactgggctactgcttttcagctctgcagtaaactagagtggtggcggcctggaggccatcaaaggtgcagccaccccaagacctgctgtgctgtttcagcaagcctccattaatgatagagattttaaattggttttctgactccctggaaaatcgtaccttttcatttttgtagttcctctcttggttgtattgtgcgctaattctctattttcaaactggacttgttaaccccttttttttaactccctgtagtctttgatttccattcgacacatttaataaatgtcaccatttaagattcagttatccttcttaatctctggatagtccattctgatgcactgcatactttccttaaatgggttgggggagaggacatcgtgatggctcttcccgactaaggttgaaaggtgtttcaaacactggacctcttcatcttctgggagttgaaagctgcaagttttgtgctcaaagagaataaaagagaaaagtggagacaatcttattggggtggggttgtgctttggatcagttactgtctttttttggatttttaaattaatgatcatttttgaagttggagctactacaaaaatttggtgagaaaggttaatgaataactgcatttttatattccagtacttttttaaaaaatcattttattctaaggattttgtcttcctttgcaggattttcagtgcttgccttttctgtatttacattttccctctatcataactggtatgtctggttgcactgagttgtaattaacagaaaagttaaatctacgaagcccgaaaagccttgttctggaataatctatttttgggtagttttaaaaatagcaggagtctgggattttatatgatatttataatttacccttttttttctgcttgcatgaagatagcagttcacatacatatatttcttggtttaacttctggtcatttggctatttgcaagctgagtatttagtctgatccgccattttgtagtcttgcattcaggcccgggatcctaatatggcagatccctttggaaaggcctcttgaagtttcaaggtctgtgtcctactcagtgaattggctctgtgctagggctttttggaggcagggagtggcagcccttcctgtgatgcagaggaaggaagcttggttgagagacccttatgttgttgtctaaggcagggtactaactgatttggatttattcacagaccttgccttatcttgatttcactattctatctgaccagtgtgtcattgccgaaatgttttccacatttatagttactctgtatctttatgtttcccttaccctgttccttttcctaataaacatctttgttttacaaaaaattttgtttataaggtgtcaaggatgccaagataacctcctttgtttatcagcgccctctgtttagctattttttaggaagaatcatttaagcaggttgtgagtactgccctcaattacttggacaatgaagttttaaaaatcttatttagacctgtcactggtcctgtctcctttttttttttttttgtggcccagggccagaaagcttgagtgagaattgttactacttaaggtagcctctctccatttctggatgctagctggctcaaagttttttttttttttttttttttttttttttttttaaatagaccagggtctccctatgttgtccaggctgaactcgaactgctagactcaagctatatcctctccctcctcagtctctctctggccactgtggctggcccaaattctctttttgttaattctcctcagatttgttttggaggcaatgaggtttcttatattcatggggtacagattagcagcctatcattaaccttatttttttgtttttaggagacagggtctggctatgttgcccaggttggagtgcagtgatgcagttatagctccctgtaacctcaaactcctggatcaatctagactcctgcctcagcctcccaagtgcctgttagtacaggcttgaggtactgtgcccagctaactttttatttttttgtagagaggggtctccttatgttgcccagactggtctcgaactcctggactcaagcagtgcccctgcctaggcctcccaaagtgctggcattgcagccatgagccgctatacctggccaactttgtttatttttattcttgagatcttagttaaattttatggaaaatttaggccgtaataaaattgggattccattgctttttgcttttcaatatatttccggattattactttcagtgtaagtgatctgagggcaaacatttaacaccctttctatatgatgattttttcatgatgtcctcagtttcataaaatgttggtttctgtgttggggatgcagttagataaatgcatgtgtgtgtgtatctagaacattcaataaagtagtgttttcaaaatcttatagatgacattttatatgtagattaaaaataagtagatttaagccaggtgcggtggctcatgtctatagtcccagcacttttggaggccaaggcagaaggatcactggagcctgggagttcaagcttgggtattgagaccccgtctctacatttaaaaaaaggtaaattcagaaagttgaaataatagaatattttggtttgatggctatttcctcagttgacctcagacctttcatattgagcaactgccgaatgggttctttttgttttttggtaagacagtgtttgcagttgtacactattagattaatcatggtttagttgatagtttctttaattgtattatattaaggtactacattattagctgtatttgtgtgcccaccataatgtagcactgatcagtactaaattcctttttatggctgaaagacattcgtttggatatatcatattttcttcattcgtaagttgatggacatttgagttgtttccactctttggctattatgaataatgctactaggaacacgtataatacgtttaatacaaagaattagtttcacaaggttttacttagccctcgtatatgccaggttcttgaaattttgtctttttggaagtatgagagtagtggtagctgggaaggctgcaggtataatagaaagaacatgaactgtctgggcatggtggctcatgcctgtaatcccagcactttgggaggccgaggtgggtagatcacctgagggcaggagctcgacatcagcctggccaacatggtgaaaccctgtctctactataaatacaaaaattagctgggtgtggtggtgcatgcctgtaatcccagctactttggaggctgagtttgggtcttgtaatattacttcatctagcagtagagttagtgtcatatgttactttcatgattaacatttttaggaagttggcaaagtctatatataacactttatgtttccaccagcagtttccccacatcctttacaaatattgtggtgtcagatggtggcatttcagtgggggttttttcattttgaggcagggtctggctctgtcacccaggctggtgtgccagtggcatgatctcaggtcactgcaacctctgcctcctaggctcaagcgccctctcaccttagcctcctgagtagctggtaccacaggcatgcaccaccacacccagctaatttttgtatttttttgtatagatgttgcccaagctggtctcctgagctcaagtgatcgctggcctcagccttccatgaaccattgcgccctgcctcattgggattttgatttgcattttttagtgactaatgttcagcatcatttcatatagattagccacttgtatgtgtttggaggactgtctattcaagtgttttacccatcgtagcaatagaatttgcccttttattgttgagttgtgagagttccttacatattctggataccaaacttgaaaaaatacttttttgaggtgtgagtgacatacaaaagctgtagatagttaatgttaaaagttgatatgctaagagataagtacatgcctttgaaatcattcttatcaaaattagtggcataaatgtgtctgtcacctgaaaaagtttctttgcctctccctaccttcttttttttcattgtttggattttctttttgtttgttttggatactagaaacttagctgtatgttaagcaaatattttttcctattctggttatcctttcactttctttagtgttttcggaactttattttttgatgaagtccactttattttttatactgcttgtaattcaggtgttatatttaatagaccattgtgtaatcaaaagtaataaacattatcagtgtataaaattttaccatttagaaatcaaatatgtgtgtatggcttgattagaacatttaaactcttgaaagaataaaacagctgtgcgttattggtaagctattttaccaatctaaaagtctaacatgacttaaaaacatctagggttcagagaattattaatagcttttggcatgtatctttgaattttgcttttgagatattacttgtgttactttagtgaaaggtcctgctgacctttctgatttatcatctttaaaggttcataggtggtttctgcagtccctaatatggctagtctggtgtgggatttcatgttctgttcccttgagcagccattttatgaggggttctgcagacgtaacatggcgggttttttgtttgtttgtttgtttttgctatgtggatagtttttagcttgagcagctcttctattgctttgcaaatcctaaagaaagcaccatttgcatgtttttttaaagtagatattttataatttaaactatgttctattccactatataagtatgtctactgtatcctaaaaatattttttgaaaccattttggaaatcaggtttactgtttttggggggaaggtgagtagggtagtggtggtatgtatgtatctacatctgcataagtgggaattttatatgtacgtgactacaaatagaggtagatatattattttaatttcattttctgattttttttaaaaccagattttctgatgtcatgggcttctaaaaggagaaaaaagtggttatagcatagattatgactgtttgaaggttaaagatcttgtaataattttaccttgttttaattagatttaaaaatccattatattaaatgtagttctaaatataaccttgacaaatagttatttcatagattgatgcagtctaccaaacaaatgcctctcttttctgtttcagggatcgcttacacctgagacgaactacagaacagcacgtaccagaggtggaagtccaagtcaaacgcagaaggactgcctcactgagcaaccaagagtgagtacagactgtgttgggaacaaatgcaagtcagaatctcctttcagattagaacaaaatatcatgcaatgaggggattaaaatgaacataattgaagaagcagacacatctaatacagaagatgtagtaaaaaagcaatgaaattcttaaccatattatcctaaaataattcaccctcttaaagattttagtataattttcttttttcctatacgtgggtaagtgcattttatctttataaaattttgtaattacccttcaacataagcatacttaaatttttctgcattattaaatcactttgtatgcttgcaaaatgtactgtgcgctgaagtgattaatttacatattcattcttgctctgtgatatttaggtgtttgtttttggttagtgcatttattctgttaaaatttaaaatacatttgtgttttttatcctgttttaagtatatatatgtggaatgtatatataggatgtatacacagacacactcagacacatattttaatttagatttctagaagggaaattttaattaaaaataggtgaacattttaaatgacctaatacatatttagtccacattgaaactttggcattttgtcattgccattaaaattttgatggcattaaaatttgatgccattaaaattttgatcagtaggtagcatttttttcttagctacaattgttttttttaattataagtattaaaaattcatgaagatgattctttttgtaaaacagttttgcataaaaagtaagtctcattttaaagcaactaccaacttaactggccttttcctccccagagataatcattaagtaaatagccatcagaccttgtcctatgcattgtgtgtgtagtggggagagaggaagggaggacatgggacacatttgaagtttgtgtgcatacgacaccgtgctgtctgtattttgacaatatgtcttggtgatcttttcatatcagtacacataaatctaccttattttacaaagtgtgcgtggtgtgataacattattattgtaatcgttagcttgctgctggatatttagtttgtttgcattgtttggctattaacaatgaaaagaacagtcactttgaaaacgcagtgtaggccaggcatggtggcccatgcctgtaatcccagcactttgggaggctaagccaggcggatcacaaggtcaggagttcgagaccagcctggccaacatggtgaaaccccgtctctcctaaaaatacaaaaattaaccgagtgtggtggcacgtgcctgtaatcccagctacttgggaggctgaggcaggagaattgtttgagcccaggagacggaggttgcaatgagctaagatggcaccactgcactctagcctgggtgacagagcaagactccatctcaggaaaaaaaaaaaaagaaaatgcagtgtatgaatactaatttattttatttttttcaaattaaaggtttttcctcatagtaaaaactgagtagtagtttgtgtgtcttttgttatttcctcattttatatgtgaaaagttgagctggatgtggtggctcatgcctctaatcccagcatgttgggaggctgaggtggatcacttgagcccaggaggtggagaccagcctgggcaacatagagagacctcctctctacagaaaaataaattagccaggcgtggtgttgtctacctgtagtctcagctacctgggaggctgaagtggaagggtcacttgatcccaggaggttgaggctgcagtgagccatgtttgtgccactgtactccagtctaggtgacagaatgagatctagtctcaaaaagaaaaaaaaagttgtaaaacatctgttagcaagttttaaattatggtgagggtaaagattttttttttattttttcctatttattttgccgatttttactatagtgagtatatttaagtacattttcattttttaaaattgctttggaagacgtattttatgtacgttttgtttgtatattggtaaatattttgaaagtattttgtgtaatataatttgtcctttatatataataggttattcgatcattcattttatttgatatgaaatctcttttttcatctcttcattctttttgagacggagttttgctcttgttgcccaggatggagtgcaacctccgcctaccaagttcaagtgattctcctgcctcagtctcccaagtaactgggattataggtgtgtgccaccatgcctggctaattttgtatttttttagtagagacagggtttctccatgttggtcaggctgggctcgaactcccgacctcagatgatccgcccgccttggtttctttcccaaagtgctaggattacaggtgtgagccactgcgcccagcctctcccttcattcttttgcagctctgacgtttttttaaagtgccattactattccctgagtttctagaggtagttcagagatggtggtggaggtagggctgaggtttaggactcttaggtttaggactgttaagtgggtgaaggttctatcttgctatatttttgttacagtttttttcctatgtaacctcagtgtggactaaataacaggtagtctcatcctcatcttgttgtgggatgacgttagccttctaggcatcttgtccatatttatggaaacattttgatggttttgaagaagaaataacttgagtttttcttatctgcactgcatatatatgtacaaatactgcagggtcttgagttgggggaatgatctgagtaaagtgtagagttagggaaatagtataatttttcccccttgtgcgttttcattttgagagtaattggattatggaatgggtaagcaggattggttaacactgcctcattgtccatgtgtttaggattctcaggattggtatacttagaatgttatactagaagtgttcaatatttacccattcatctcctacttcctaccaaatcataagtagtattgggaggcagtcttcctggaggagttgtgtggttattagccctaaagatcaatgaaggaggctgggtgcggtggctcacgcctgtaatcccagcactttgggaggcgaaggtgggcagatcacctgaggtcaggagttcaagaccagcctggccaacatggtgaaacctcatctctagaaaaataaaaaaatcagccgggtgtggtagtgtgcacctgtaatcccagctactcaggaggctgaggtggaagaatcgcttgaacctgggaggcaaaggttgcagtgagccgagatggtgccattggctgtgcctgggtgacatagcaagactccatctcaaaataaagtaaaaataaaaagttcactgatttattttaaattttttattctgtctttcagtgtatttgtcactaaattagctcttattctttggggctggatgatgtatcgtgagttcgaagggaaattggaaattggagctggagagttgtcttaatatattttatgctaagcttcacatgtcttttcaaattaatattctgcactctatgaattaaattctgtgtaggctgcctcattttctcagtctttaatcttctattgggttacaggttagatctgagggggacattgcaatagagaattatcttacgtttcaagataacattatatatatttttttttactgaaacactttttagacctttatgaataataatcagaaacttagttgtcatttgtaaacagaggttagagtggagaatgcccaaattaagatttatttattcagtgattagactatgaattagagtataaagtagactatgaattagagtgtgaagatttagaggtatgtgcagtgcaattctgactacttggagttagtgcaaatttcacagttgtctagatgccctccagaacattcccctcaatgcagacaccaactccaagctccagggttggcagggcacccacacttccgaccaacagtctatagattctgaggtcctactattttctcagactttataattgactaaggttttataaatgactagtagatctcaagaaagtgctatacttactagttttttttataaaggatacaaatgaacagatgcatagagcaaaatctgggcaggtcccacacaaatcttccctgtcctcaggatgcattacctgcacattagcgtatatcaccaatcaggaagctcaccagaactccagatgtcgatgatttttgttggggattcattatgttgacaagattgaatcactggacatgtcactgaattcagtcagcaactctcctgccctcccaggagggcttgctcaaaaccccaaccctttagtctttgtttgatcttttgtggcctggttagtcaccatcttgagacatctcattaccaagaactcaggtgtgatcctagggacccaccttgagtaacaaacacatttctttcactgggtaaattccaaggatgtataggatgtataggttacttcccaggaaccaggagcaaaggccagttaaattctttattatacagaagcaattttaaaatgttactgaaaaaccatagaaaaaagtccaatttccaaatccttacatgccaacaagggcagcattgttggtgatcccccagctcctcacctcaaggcaagctgtcatttcctgtatgtcttccttctcatcatcagatttcacagccaggttactgattcataggggtatgtcgagggcttttgtctggaattccctgcttaccagtagatgattggtttacatattttaagagcccttaaatagccctggaagttctatatttcaggtagtgacttgtcaggaggatcaatatgaaggacggcctaaacatctccctgcaaatgctttagcagcatctccctcccctcacccctggggagaaaggattgttcacacaggataatttgaaagtgagtgactatatatggtactgatggtgtttcttcaaggctgccagctcttgtgtttttagttcttttggaaatatttctagacttggtaagtatcttaagtatccactagtcccttgtacaatctctgtgtagagattcctgttttgtgttataatttctcataagatagtgtcatcctctgaccctaaagaaagatcttcttccctgggcgtggtggctcacgcttgtaatcccagcactttgggaggccaaagtgggtggatcacctgaggtcatgagttccagatcagcctggccaacatggtgaaaccccatctctactaaaaatacaaaaaaattagccgagagtggtggcaggcacctgtagtctcagctactcgggaggctgacactggagaatggcgtgaacccaggaggcggagcttgcagtgagcccagatcgtgccactgcactccagcctgggcgacagagtgagactctgtcttaaaaaaaaaaaaaaaaattagctgggtgtggtggtaggtgcctgtaatcccagctacttgggaggctgaggcaggagaatcacttgaaccccgaaggcagtgtttgtggtgagcagaaattgcttcattgcactccagcctgggcaacagaatgagaccctgtctggaaaaaaaaaaaaaaaaaaaaggaatatcttcttaaatgtaagggtacctagttttctttcatatggtttcctataaagacaaatgtatttttatcatttatatatattgtgctcttgttgtaggtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggttagagctaatgcagcaatgatcaagaataaagaatcattaaagaatggggtgttgggggttctcttaattatcagtgacacattaatttttttccttagagcttcatacaataaacacattgcagaaagttttagaaagttttgcaggaccttaaattttctgccctgacactttcgtcatgtttctgtattccagttattgtagcgcatgcttttcaggtagttttcttttgcgttttttttaattatataaaaatatttcactataaatggctcttgaataccctgttactgaatgtttataatttccttttgtgggaggtgtcatttttttctgccagtagtttgaacaaagctttagtagatagctttgtataaaacttagaataattttttcaaatatgcagatgtgaaaataaattgaatcaaggaatatgaacttaaggtacatttttctaaattatattgcaaagtattaaattagtattcattgctttcgaaaaataaagggccagttacaacatactttcacagcattattttaattcaaatatggtttatgtcagtgaattataaatacacagcacataattaacaatgagtattagagaatctaaatactttctcatgcttatttactaattcctttttgttttgtctttttctcacttttctgttttaaccaatgtatttcctctttgaatcagcagacaatgtaataaaaatattattcataatttttcaatgtgatgtagatttatttagttctttttatgttgctttcattttttaggaaaaagttattacaaagtcgattttgatttgttttcttgtttttcctctgtgatttttctttttttctactttaagttttagaatgccctcatttctgagagtttactatttactttttacaaagtaagagcagagaggaattgggtttactgataaattccttctagcctttttttaagtctgtttttgaagtattatccttcaacttgaatcagttaggcttgtttatggccaccattttgagttattaattaatttatttatttagagatgaagtttcactctgttgcccaggctggagtgcagtggtatggtttcggctcactgcaacctctgcctcccaggttcaactgattttcctgcctcagcctcccaagtatctgggattataggcacccaccaccacacctggctaatttttgtatttttggtagagacggggtttcaccatgttctccaggctggtctcaaactcctgaactcaggtgatccacctgccttggcctctcaaagtgctgggattacaggcgtgacctaccgcgcccggcccattttgagtttaaatcaaaggagacagaaattttctgagaaatcctcctttcttgaatcctttatacacaacattttctagcaattgcataagcaaattggaatctaatcattgtccaaagcttttcccttgagtaagggaatttttcattgaataggtgtgcacaactgattttttactttttaggaattttttagcttctcagttcagttcacagatttttgtaaatttttaaatacaacatttaagtcatacattatagtctgcaagtaggaccatctaattttatgatacttaattatatcttattctagtctcaactgctagttctacctaaatagtacccattactagtattcctgtagaagaagggttggtaatatatctggaccactacctgtgtctataaatgaaattttattggaacacaactcagttcatttattatgttatctttggccacattggtgctacggtggtgcagctttgagtagttgtgacagattgaatgacaggcaaagcctaaaatacttagtatcttgctatttaaaagaaaataattggctgagttttattttagaggagcagattgaaagaagaaaacaccaaagtgggggccagtcaatatagtcataatgtcatagaaggtgataaagaatagattatagaagtatatacgaagtatacattacagcgtagacaatcagatgaatttcttggggaagggatcagtctaagagtcatgttaaagtctgctgtggaggaagatgggtagtctttaacaacatttaaacacttcgtacccgttttcattaaaaatgtaaggcacacgatggccaggaaaaataagaaaataaactattaatgtggccgggtgtggtggctcacgcctgtcatcctagcacttggggaggctgaggcaggtggatcacctgaggtcagaagttcgagaccaacctggccacatggcgaaaccccatctgttctaaaaatacaaatattagccgggtgtagtgggggacacctgtaatcccagctactcgggaggctgaggcaggagaatttcttgaaccctaggggcagaggttgcattgagcagagattgtgccactgcgcttcagcctgcgtgacagagcaagacttctatctcaaaaaaaaattgtgttatgaatattctgtttttctttggtacctaaatatttaccagggtacatatccaactggatacctacctagtagttgggatgcagggtgtaatattagtatgacttttaaacgtttttgttacattgttttctaaacacatcatgagaagtgctgatggccactaaaaattagtagaccattagtttctcagtaccaccctttgtattctggtgtttttttgtttttgttaaataaacctttccaataaaggaaatttgttttcttgtgtttttaattggaattattgtgtattaatattttgcatttagttttcttttgtcacttgtttttgcatactcttcgatggaggatctctatggagaccctctataattttaaattttaacagatcaatactgatattccatggtgtgtctcatttgctatgtgtgccttggccaaccctagtcatcttattttactatttgctatgtgtgctttggccaaccctagtcatcttattttacttttgaattaaagtagatttacatttttatgtagtttaatcatttgaaagtctacagtttcctaaagtttgaaaacttgtgcttctgtgagggataccagttcgttaatttgcttatgtgccctttgatctcagaagatacactatgactgctcatccatccttgcagtgtgatgttgctactctcgtcgcctttctcatgaagttttgttttcttgtgctgtaaagataaatttgaccactctgcagtgatttattttcttctttcacttacaaggtcatgactacattgtatcacatttagggatgagagagaactgtttctaaattccaaatctgtctcttaagggaatccttttaactgctgtaggaggtcaactcctattgtgagtaaaacatatatctcttctagctatacaggttattattatattatgatatatatataaatataaaataataatctgtccctaattctctaggtcttcagttctttgggccataactcacatccctagatgtgtttcatacctctggaccgctaagcttgtgggagttatttatatcctattgctcaaggtcattgccaaggtctgatttttcacaaaaaaattccaacctctggcataaatgggttaaaaacggctttagtgatgtagtgctgataaacataaaattcacccaatttaagtgcatgaagcaatgatttaagtaaatttacagaactgtgcaatcattgccatgaactactctggaaacattttcatcaccacagtaagatctgtcttgctcattcacagtcatgatccttgttgtctctttggatggctgaaggtcccaagtgttgcagtgctataaaaatggatattgctggctgggcgcagtggctcatgcctgtaatcctagcacttggggaggctgaggccggcaggtcacctgaagtcaggagttcgagactagcctggccaacgtagcgaaattccttctctgctaaaaatacaaaaattagccgggtgtggtggcgggcgcctgtaatcctagctactcaggaggctgaggcaggagaaccacttgaacccgggaagtggaggctgcagtgagccgagatcactccattgcactccagcctgggcaacagagtgagactctgtctcaaaaaaaaaaaaaaaaggatattgctaatgagtctcatataccatgttttcttggatttagactgctttataaagaatcataagataatattcaaaacttctaagttatagtccttaaactcttactcatatttaggacagaaactacatttaatttttgtggaggtctttgtttgcttatttgaaaagttcttttgagatctttataggttttatttaatacattttttaatgtacagacatcagattcatggccactgaatgacagccaggcattagagtattctttttttttttttttttttgagatggagtttcactcttgctgcccaggctggagtgcaatggtgcgatctccgctcaaaaagatacttttgaatccttttcaaaagtaatttgtgtttcattttttaattagtatgataagcacttcaagaccctttacaattctggctagatttggttgccatatttaatagcattttataaataatggagaaaagggaaacattatgcatgcttgattacggtcatgagctgcattaacaattccgttcaacaacagactgcatatgtcagagcagtcccttaagattacaaaaccatgttttcattgtgccttctctctcttccccaccacccccaaccctgagatggagtcttgctctgttgcccaggctggagtacagtggtgccatctcagctcactgcaaactctgcctcctggtttcaagcgattctcctgcctcagcctcctgagtagctgggattacaggcgcctgccaccacacccagctaatgtttgtatttttagtagagatagggttttcgccatgttggccaggctggtcttgaattcttgacctcaggtgatccgcccacctcggtttcccaaagtgttgggattatgggcgtgagccaccacacccagcctcttctctgtttaacattgtattgtgagtgttcatagtatgcaggatagtaacatgatatacaggtttgtagcctaggatctaccatattgcctaagagtatagtagactctgtgtatcctctaggtttgtgtaagtacactgttcatactgtgatgaaatcaccaaatgcatttctcctaatgtgtccccattacgtgacttatttatttattttgagatgaagttttgctcttgtccctccttgttgcccaggctggagtgcagtggcgcgatctcagctcactgcaacctctgcctcccaggttcaagcgattctcctacctcagcctctcaagtagctgggattacaggcacccaccaccatgcctggctaatttttttgtatttctagcagagacgggatttcaccatgttggccaggctggtctcgaactcttgacctcaggtgatccacctgccttggcctcccctggtgctgggattacaggcgtgagccacctcacccggccgttaacgtgatttataactttgtccttcattacttgatctatgaaagttgtttatgtgagtctatatatatatattccatagtcatgtgttctcttttgacatgggaagtcttaggcaggtttataacacacttggctcttagtggggaaagattacctgccatcatcttgaagcgaatttaggggaagaaagaatattgcaaatgacaacataggtatttcagaaaaaaggaaaaatctgaatgaaagagtaattgagatgttgatacagagatgacttcatattaattctgaactagagagagagacactaccttaaataaggatggaaagaaaaatactaaatttgggaaaatgacgcttagtttttgaaacatttaggaattactaggtaaaataaaattcaatgactttcatcagtcctaagtgtgtcaaatgtgagagttaagaatgagggactagggaaatgtggcagtcccttggtgaggaagctagtatgagaggaaggatgtttttgaacgtgtctgtcatagtgattttcatgcaaaattgtctgcctgttttaaaacatggtagattgcagtgcagctttaacatgctttcctctgcaggctccatctactctttgaagcttctgcccagcttgcattgtttctaggagaacctgcgtcatacctttatctatagccttcccctaggtcttcagaagcatcaagttttaactgtggacattggatttggtggaacagcaatcatggtaagctgtatgataaggctgagggttgaaatgtgctgtaagggccgaaagaaatagtttgccagcatgtgcagtgatcttgggttctgaatgttagaaataaggatacatccatggatatggattctcattgcattgagtatcagctgaagatgagctgatttttttatttttatttttttcagacggggtcttgctctgtctcccagtctggagtgcagtggtgcggtcttggctcactgcaaccctgggttcaagagattctcgtgcctcagcctctttattagaaacagggtttcactgtgttggccaggctggtctcaggctcctgacctctggtgatccacccacctcggcctcccaaagtgctgggattacaggcatgagatgagccactgtgcctggccatgagaaatgtttcatgatgtgagaaaatacaggagtttttggtcatgattccaccagtggtgaaggactgtcctgcagatgatggactctcaggtcagattacaatagaaataaagagggctttgaaaatggaagggttttggcattaacagtacagagaaaagcagtctggagagagagaacaccctacatcattgtggtttggtttacttaggggagtggacagtttagagcatgcatcgtcacagagaaggataatcacctgtaaggaggtgaaaattggttcttgagatgtgaaaaaatacttcataatcctttgtggtcctccaaagagccatactaaatatggaagaatgttggtgaaaaaggagagaatatttgtttagttaaggaaaccaggcttagattatgtaagggtggagaagaaacaggagaagattagaagactagggtgttggcaagctgaacatgactcttgtcttactgcttctagactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagtaaggctgatttgggcaaatgggggttggacacagaggcagtgggaagggaaggccagagctggagtaagggatttccgagggtaactgaagtagttagggaaactatggtagagccagtctattgtttaacctcttgacctgatctctgaattaggtcagagtctgcatctgaactcttttaagtttgtaaaacaatcatggatttattactgggagtaaaagtatatgctatggtcagaatactcgtatttatttttaaaattgagaaaaatgctatattaattaattggttggcttctgcagcagtcttagaccaaatcttggttgaaatggagaagaacagttgttcttcatggttgaggagttgggatatggttgccatttggtatcctctctttgcctatcactgttcccattatttcagttctgtgtcacctgtcattatgatttaattatttaagtaattttttaaagaaatttccattttaatgtggaaacccaggtttcaattttgtttttcttaaaaggtatttcacaaaagaaattagtcttgttgtagtgtaacatcaaaggaacattctgtaaaagactaaagttagattagaaaatagcttcactatttacccttgtatattaactgtgtttacagatattttttggcttgtttttcagtgataactcagtaaatgtttagcatcagttgtcttaattgatacttgaggttgtataaatattttgatgagtgagtgatcactaaaatttatctcactaaaatttaattctgatttgtaggccaaagaatgcgaagcaaccagagcgtgaagaaaagcgggttttgggtctggtgttgctgcgtggggagaacttggtatccatgactgtggaggggccaccccccaaagatgtaaggaagatgtagggcaggacagaactttaatttgcagggacatcatattatgtgagatgtctgaaatcagggtagagcagacacagttcaacatggattgtcaaataaaatgtgccaggcacttaatatcaattgttggttgcctatgctattcgggattaggggatttttggtgaattattctatgtgctgggcattacctaggtaagggtaggagttggtgattcatgtttgcttggtatgtttataaaagaggtgttttcacaatttgacaaataatgtgcattttatacacaagatacctccatggtatacttgcttgtttgttcatttggacacagaactaatatgagataggtgtcatgggaaaatggtggagagaagtgatctctgatgaataagaatactgagaacttgtaaattgtttgattttaggctatgaattttcttgtttcagactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtgaggaaccagcagagggttttatattattgggagaatatgactaagccggaggccgaggagatttaaaaacctaagtgtatgtgtcatacaatgtaaacagcatatggtttaggaggaaccaaaacacagatatatgggaggaagggaataaaactagctgcttaaaatggtcattgggtgattaaagttacccaggttactcttggcaagagtaacttgccactagtggtgagtgaacagaatgcatggatataccacagttgaaaagaccaaagggctttttggatgtcagtgtactaagattagtttttaaaatatgggaataggccgggtgcagtggcttacgcctgtaatccagcactttgggaggccgaggtgggcagatcacttgaggtcaggagttcgacaccagcccggcccacgtggtgaaaaccctatctctactaaaaatacaaaaatcagctgtgtgtggtggtgggtgcctgtaatcccagctaccaggcagggagacaggagaatcgcttgaacccaggagtgggaggctgcagtgagctgagattgcgccattacactccagcctgggtgacaagagtgaaactgtctcaaaaaaaaacatgggaataatgagagaagtacattgcaacagttgtttgtaactaattggtcatttttctcatttattttctgtgtttgaataatgtgaaggtttgcatcgctttgactgtttcccgccctgccttctcaggtaatgactccacagggaagaggcactgtagcagctgctgctgttgctgcgactgccagtattgctggagccccaacacagtacccaccaggacggggcactccgcccccacccgtcggcagagcaaccccacctccaggtaagggattggtgaacacgaagacgaacttgaatctctgatgagagatagcttactgatttaagacacagcctgagagcctaagaatttggggaatatgcttccttcttctagatactggtttttaatgaaagacatagaagagtaattgtcatatagaagttatttgactctatcattgttgtctggcccatttctttagggattatttgggctaaattctaacttttctaagccattttatgaggcctttatttctaccatttttcactgtaggcattatggctcctccacctggtatgagaccacccatgggcccaccaattgggcttccccctgctcgagggacgccaataggcatgccgcctccgggaatgagaccccctccaccaggcattagaggtgagtgggagcataggggtttgatggttcagccaggcccctgaatatgtgtatcctctttttctcaatgtttctatttcctttccaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtgaggtactgttgtatatatttttttgcctgttgattttgatgagatcttaagttactgtggatgagggtgatgcctattaagcagttgattcaaatcatattctctttaattcttaggataaaaaggttttctgctatctaactttcactttgtgcattgactggtgttggttaataatgttttcatgacccgggggtttaagtggttgtgctgcttcacacatggcctcctgcttctcatgttgctatgtcacattatctgaagggaagtggggatgggatgaaaggccttgtaaggccacctatatactgaaggaagttgtagtgaatcacagtccatgctcattacatatcaaggcatttgaaatagaagttactctttttcttgggatgttgacctcagttgatcaggttttacagtgtcctatgatcagaatagaggatgtgatactggaataatcattttctaccattgagtaagtatttatttataaattactaaatgagtggaagatcctgggtactgggaggcaggaggttgcatatttgagttgataagttgtactactgataataaagataactgacacactaaaacatacttggtacactgaaatacaaattacggttatgtccagtggtatcaccaagtgacaaactgggagctaaatagttcagaaatgccctagtctctaggtccagtttgaattggttatggaacaaagaagccatttataaaagggaagagatttttaggttttgcagctaaggtttatagtaggcagcgagggaatgattcatagtgattgtagcagttggtttaccaagcactaaagagattggtgttaactccataatactgatagactgattggaattacattttttctcttgaatttaccaggagtggttgtgaatgtcaccttttccatcttttaaattacatccttgcaggtggtaatcactcaaggaaaaggaattatcagagtaacaatagttcctgttactgacttgatatggtctctgccagaatagcttctcagattaatggccactctcaggtaaggaaaataaagaggcgaagccttagttgctttaggagatgatataatacaggtgtgacatcagtgttttcagaatttgtaaatgttaaaacaaacttcttgatttaccaaagccacaaccaaagtactttacctggatctttcaagacagagcttctcagttcagacaaattgactgatgataagacaaacacttttcctctacaaaccgtggggtagtatgtagagagacctgtgatttcttcccatactgctctggaactacttctaattatacttttttctttgtttgtttttgaaggggaagcatttctccttgcattggtttgctggtatggatggcccttagattttggcatgagtgattatgcagcctatttgaagaaaacctgttttcaggacctttttaattaaatatggcctgttacatgagttaaaggtaagttataagagctctagattctgcaagatgcttgcttcttgtagttattttgcttggtgataatacattttcttttgtctggagcttcctggactttttgagaatcctgattgtgatgatataataggagaaaacttgggatatagatagtataattgagtgtggtgaatcttttgttatggaatgctagtctaagcttctgtgtgtttccactagggacacacatcaacatatcagtcttaaaacattcttggtagttaatgcttgatgttacttaaaaatcatcctacattcttgcattaaactacatacacgtggctgggcgcggtggctcatgcctgtaatcccagcactttgggaggccgaggcaggcagatcccgaggtcagaagatcgagaccatcctggctaacacggtgaaacctcgtctctacaaaaaattcaaaaaattagccgggcgtggtggcaggcacctgtagtcccagctactcgggagcctgaggcaggagaatggtgtgaacctggtggagcttgcagtgagccgagatcgcgccactgcactccagcctgggcgacagagtaaaactctgtctcaaaaaaaaagaaaaaaaaaaaaaaaagaaaatacatacatgtctcatctaaaacatggttggtcaacaactttctgatttcctgatacacattttattaaccggctccttaaatatatccatgttgcatatcatgtttgacatgctttcattgtagcttatagaataatttcaaatagaattttgggataaaaattatgctaccttaaaataggttatgaagtatttgaggtattctctttttatatgataggtaaacttggcttggaattaaaaagattttgaaagttgcttagggagctccctgcttttgtgaactcattattccttaattatgatgtcaaatttcagaagtttgttattaacataccggtattttgctttttatagattcttgtaatagaatattacaagtagaaactgatttacatagataattatgtgaaatagtgctgcttgactaggattttcatgatctcatttcaaagattagcaaaaacaccctttacctggtatgtttacctctgatactaccttcactgatttcagcaggtagtcagttataatccatggattgaagttttgatttatttatttatttatttgagacagagtctcactctgttgcgcaagctggagtacagtggtgtgatcttggctcactttagcctctgccttccgggctgaagcgattctcctgcctcagcctcctgagtagctgggattacaggtgtgggccaccacacctggctaatttttgtatttttggtagagacagggtttcaccatgttggccaggttggtctcaaactcctgacctcaggtgatccgcccaactcagcctcccgaagtgctgggattacaggtgtgagccaccgcaccccgccatgggttgaagtttttaaatgcatgttttccggtagttaatacattgcttgattctgtcttataattgcatttcagttctcttcatcttgtccatacacataataatgcttagtatataataaagcaaggtatattttcatgggatttttgtagtgggagaatgacatctgagcctgaaataggatatttgtgttgtaactttttcagtgtcatacgataccattttttgaccacttagttgatgcctctgaaaggaagagagaatcagatcgctaaaatttgatgtgtcgtcagtgtggatcctactcagtagtgtcacaacgaggctgaaaatcatattaagtgcttttaggacagaaacgtaaactgctcaggtaaaataaccttataaagagaaataagcatatattgcagaggccttggctaggttcatgatgacacaggaccttgtctgaacataatgatttcaaaatttgagcttaaaaatgacactctgaaatccagtcagtgtgcctcactagacttttcgatttcaagattttctgcagaaaatgttttgaaaactttgaatacttaaaaatggcaggtgtagtattgcactttgctagttgctcagatacccttttttatttgtatagatattctgagttcctttttttttctacatgttgtacgttgtcgaaagctaaaaggaaacttatccttggatcacggaaggcagaggcatttggtgagatggaaacaaggatgtgtaaaaatgagacgaccacctctcggattaaaaaaaaaaagtgccagagttctagggttctaagtgatgtccaggaaggaggaggaataatatttatggagcatatattatggaacacagtgagtatagtacctgcctttaaatgaatactgttggttttttaggacagttgcttttttttcttttttcttcagctgtgtgcagttgattaacttgtacagagcctatcacacaatagatgtttaagaaatattaagtgaatgaatgaggcagcattgctaatttttgtatagtgagacagtatctcacagtccaggctggagttcagtggcattaacataactcactgcagccttgaacacctgagctcaaacgatcctttcaccttatcctccagagtagctgggactacagtcgcgtgtcaacatgcctggctaattttagttttctaatttttttagagttgggatctcactatgttgcttagactggtcttgaactcctggcctcatgccatcctcttgcctcagctggtattgtaggtgtgagccactgtgccaggtactaattttttttatgttagaaaacaagtttttaggtattttatagttacttccttatgacaatatctcatcagaatctaggcctatctgatatctgactccatacgtttataccgtgtagtcagccattcccagatagaggtcatttgagttacttagtgtttaccagcacttgtttactaccttgcgatgatatttacagtgtatttttgggtatggttttggggttatttggttgttgttaaaatgcctgtaatcccggcactttgggaggttgaggcgggtggatcacctgaggtcaggagttcgagcccagcctggccaacatggcgaaaccctacctctactaaaaatacaaaaattagcctggcgtggtggcaggcacctgtaatcccaactacgcaggaggctaaggcaggagaattgcttgaacccgggaggcggaggttgcagtgagccgagatcgcgccaatggcactccattcagcttgagtgacagaggtgagactcccatctcaaggtaaaaaaaaaaaatagaaatcagcaactgctatttgagtttacaggagtgagaagtcctctcttgcatggtgagatggggaacatttaattcaatagaaatatttgagaccaggtatggtggctcaagcctgtaatcccagcactttgggaggctgagttgggtggatcacctgacatcaggagtttgagactagcctggccaacatagcaataccctgtctcaaagatacaaaaattacccaagcttggtggtgtgtgtctgtaatcccagctactcaggaggctgaggcaggagaatcacttgaacctgggcggcaaaggttgcagtgagccgagaccatgccactgcactccagcctgggtgacagagtgagactccgtctggaaaaaaaaagaaaaaaatgagatataaagttcaaaggatgtatttattaagccaatataaagtaaagaggtggggaatgttgtagaagtatatgttgataaagggatcaggtggttgtacaataagaagggggttgcagacatggagaaacagttcttctagctcttccactttcagtatcatctgtgtgggtcactggaatcctttttcacaatgcctgcttgcccatgagttttaagaactagtacagtgtagaaatgattagtaggaaaaacttggctgggttaatttgctttgctgagccgattcaacttaaaaagcgaggtccatactaagtgcccaagaatcaagaaggaggctcacatttgaacttgatgtttagttaatgtgaatcattttctgttgaactaatgagaatacagtgaccttgagggttaggttgtacatctgaattgttcgggctgtttcctgtcttttggatgttttgtttgtatagatattttcattttatgttacatcatttgttctttggtagcaaaaattgagttgaaatgatacagttcctgaaatctatgatttcatgtttcggagatatgtatcaggaataatagtgtgggttctcatgagaaaatctggattgcattactgtgctactttggtttcttgtcagagaagttagtagtttagacctccttcagaatcctttctttggactttgtgtttcttacgttgtgccagccttgattttatttgtctgtcctctgtctttctataccatttgtttacacttaactctagaattttttgatgcatgttttcagtgtactctagtcctaaaattggtttacatttaattattggggagaatagcaagttgtcgatagtatctgtggtggcattagtgtatttctgtttcagttctttggacagtttgctagtggaaatagtcattgtatttagctctgtgagacccgactggcagattgctgtctctctctctctctctctctctctctgtgtgtgtgtgtgtgtgtgtgtgtgtgtgtgtgtgtgtatgcgcgcccgcgtttgtttccttcatgtagattgctgtgtgtgtctttttcttcataattccccttaattctgtgtgctttgaatgacactgttgttgttactgttgttttatatccattgtcacataaaactcttatcatttattcttccaggccagggactgtccttatgggtagagatacactatctgcaggaatttatttttttacgtatttttactagttgatgggaaagacattgggaaagacctgggctggatttgtgatgagctgtgtttactgagcatgatgaagtaaagctcaacgtgattactctgaagtccagccttactgtcagtctaaggactcaggatacaaatactcaaaacataaattcttagactctaaatttcacatggtttttcctatcagtacaggttaaggataatggcgtgttgtaggtttttccagtgcaatacaaggaagttggttctagatcctttagtacagttaatgttttgtagagtgtgttctatgttcactgcattggtatgtctcatctttggcatgatcttggctcaccgcaacctccgcctcttgcattcaagcacttcttgtctcagcctccagagtagctgggattacaagcatgtgccaacatgcccggctaatttttgtatgcttttgtggagacaggctttgccatgtttgccaggttggtctctaagtgatccacccgcctcagccccacaaagtgctgggattacatgcgtgagccaccgtacccagccacacctttgcttatttctactatgcatttcaagtgatcatttcaagagaataagtacttaggagctcctatgctctttttttttttaaccctgttgcttgcatcacccggttccaaccctatatgaaagtttcatgagcatgtttctgtcactgaggcagcttctccatttggcatataattgagaaattgctagtttgtggctgagacattggtttgagaggagacgtaatttatatatttagcagaatgcttaagttacatttccagagattaatttaattctacttttaattaagttaaccctttgctgtatctttacaagacgtaggtggagatttaattttgactcttagattcagttaaggtgatgaaattggcattatatagtttttgatgctgagccccacggagattaaaagatttgctaaacaccatgcaatttttgaatcacatctctaatctcacattattctgtactctattttttgcttgtatgattgatgggtctttcattatctgtgattgacattctatgagtaggtgcttttgctttgcctataagtcgttattatgaaggaggaatggtgaataagaaggtaatttagaaaagcctatattaaatataccatgaacattgaatatagcaagatcttattctctagttgttatcttagttgataaattctgtatgtgttatgtgtttgtgtatacatatgtacatattaatgatgtgggtgttgatactgtgatcacatgacaaatgactggtttatagtgaaaagctgttggggttcagagaaatgaacattcttctaaaagtgaggtagataagttattttatagttcttgcctttgagtctctgttcttctggtagaaatgttagtgtatttataacctctcagatttgtttggttctcttagtgttcttgatccaggcagttagcgatatgttggatgaattgagaaaaatgagtttttcctttcctactaactgaattagattagaaataagcagttaagtgagaaaaatagggaattagtgccagatatgttgaggtgtagtgttgacagggggtcttttaccttcagatgtttggtgcaacttagagaatgcagtggtagttgctggcccagcccatccaaacaacctcatttgtggggtgatacttcacagatgacttaaaataaatcccctgaaaataagaatctctggaagagatgacacgtgtatgtgcgtgtgtgcacgtgtgtgcgtgtgtgcacgtgtgtgtgtgtgtgtgttttggtggagtggtaggaggagggttggcttaatgatgagaatcattatttcttgaattggatgacactttccattcctgcaaagggagcgtgaggtccagccttgctaattcatgatcaaagtaatttgctgagagtagtggaaggaatgagttagcagaagatggcaaattgcattaatgagtagtaggaggaaaacaaataagcaaattttaatgtggttggaacatgttcctgagttgtatgaagggagacaggtaaattgagagtaatgttatgattgtttcatttgttggaaataaggaaaacttgcatggtttgaattgtggaacaataggtggtgtatgttaggagtcagaattatcatttaacatgtaagtttctgttttacttcagataaagaatgtcagctacctttcccatgttagcttctataccttttcttgaggtgaccataaataggtaatattgtctttcactgagattgttttaattagcgaagtgtgctgattaaatgtcttttcttgataaattattagaatgaataaaggatggtatttctagatagccttggttagtcagtgatttgtttaaatttagtgtggataagaatcacctgagggctttttaaacacagtttactgggtcctgaccttagtgtttctggcttattaggtataagtatgagaagttgatttttatcaagtttctagatgctacagatctaggaaccatacttagagtgctattatatgtcttttaatgtacactgatatggaaaaagcaatgatacatcatgttatcgcatattttaaaatgtgatcatgaccagggaatcttgaaagttgtcttatgtaataatgtaaatcaatgtagaataccatatatttttttcttgcaaggttattattaataggaatgactatttgtagccaatgtgttcaaatgcatgggaggacgtaaacacttcataatttcctggaaatacagacatatatcacttaaaataatacatttctaatataaatttaaattatctacgtgatatgaggaaacgagcttatttttgataattttcctagcagtgaatcaactatactcatttgaatctaaattaaattaaatttgagtaaattcagccatttctaaattcagtccatataaattcactttgggtaaaagaagacaaaattcctgaaaacagtagattaaaaaaataacattttaagagcaggtatgatctcaatgaatatagtgtggtaatttctgcctaatacctacccttttggaggaaggaaaggtaatcctgtttgtgtttaatgttaattactgaactctttataacttgttttatttatttattgtttgattttaagcatctgcttctggtggacttacatatgttgggtttgggaaatttcaacatacaggttggcattccagtggctatagttgtttcttgaaatttagtactgttttccaatgatgattctctttgggaataggctgttctcttttacttaaaaactgtaaaattagccacttcagttgagactcctccaggtttggaagtggtgaagaatatggatatattcagatcaaatcagtcattctctgtgatacagcaactgaacaagaaacccagacttcaaacaagcagacttctttgggttggactgaataaaatgagaagaaattacagaggatttgaaaatgtatatggcctaggaattattgaaattattttggagggtggcaacaaatttgggacattgtactttctgttttaatgtcaattgtataatgtgtaactctagtgagcatggctggataccgtggcttcacattttaggtagactgggtgttttatctactgagtgaattacagccttcggcaatgatgtcaaggtagcaacaaaacccaaaaaatccatcctttagaaattgttttaagtcacaatgatgataccttctttaaaagctttgacttactgaaataatgcttttcatttgtccaagatgagtacatagcagaatttggaaatatggttccaaaaggctaaatagactgacttttttgatatttttcccttatagggagaaagaaacattaacggtttatcagatgccttgactgtactttttactgctttgtcttcaaggcctagtgtaataattaacatctagtatgtgtttgatggatagccaatttttgcttcattggtatgttgttaccacagtcattggtagagtcaatatatgaatgaagaaagtataacaaatttgccctctagtagagtacaggcaaagtatggccgtcagtttcaccctgattttttttcctccattcttttttagggtttaggtcaagaacaagggcatttcattgtaccacatagctgagagtagggaattgggacatactgtcttgctttaaattaaagttgtctgtttcatcaagtagagaggttcctaagatattgccagatttctgactcggggtttgttaaaaatagaaaaggtagttccttaaggttgtattttattggatgcctccacctgcttcaggctagctcactggagaataaatattccaggttaaaaaaaaaaaagcatgtgttcacgtgaacttgtcctttgagcaaacctgttggaaatcaagaggtcattgctgttggagaggataagagggtgtacttgttggtgtgttaagagtagttcacaacataaaaataaatgtaaatgcatctattatatttgggttggcaaaatatattggttatttactctgttgattcctgtagtgtacataaatatgatctacaactctgtgaacaaaaaggcttgaaaaattgttctgaaaatggacaaatcatgaacagataattgaacaagaaaataagcagaaagtaaatttgtgaaatatttcaaactcatttacattcagaaacatctttttaagatcactgtgatacattcgactgtcaattctgaagagacgtataaaggaaatgccagctaaggagcaaggaaacagctttcattcatgggctaaattgcagcttaaaaaagatggaccaggattatttcctttagaaacttactgtacaaaagatactgttcaccccattagagaactgatttgaagttactcttccctgtgagggctctgtcatcttaactgtattcacatactttcaactgttccccttgctgctaacctcaggttctttagttcatctatctggcagagctgatttggggaaaacaagacaaaccttctcaggttttcttaataaataagcagttgtcatgtttcaagagttttagaaatgagcaataatcaaggaagaggacaacgattgcatacgtttataatatttagaacatcttttgccacaataaacactggaaaccacccacttgtggacaccaaacatttggatttgtatattttgtggcattccctcactctaatcctctcatccttaaaaattttcagaaatttttgcagcaacaaacactgattgcaacatatgatttagggtagatttatgaaccattttttcactgaaatacatcaacaggagtgagtagtctgagtgaccaccccagcatggagaaaactgtagtttacagattcttctggagcatttttatttctagattgcggtggaagtctaaccccccttggagatgtctgccttaaagggtctttggccagggtcctctgtagagccatagtccagatctactctatttgtgtgctccttacaacatcagaacagcaactctcaatccggattcatccccagaatgccgtctgagtcacagcgtggcaggtgcataaagaattatctactgaattgagaaacatttcaaatatataaaacttgaaatattttgggtagtctgtacaaactcaagttgacaagccaaccctgcaggaatatatggatagaaggggaaggataacatgttgaattcagctacatgcctcatcagctagaaaaccttggaagaaagaaagatagattgatacttgcctgaacttcatcaaccaataatattttttttcttgctatggagagtccactcgcctttggaagatttaccagtaaaagccctgcacatgatatacttgtgtgcacatgcaataaggacatcattccccaactcctgctagcattgtgaaagagctccaaatattcaaataatataaactttttttcgtggacatttagcttacgagtttgtttaaatatgtgggaaaattatgtttagataatagtattgaaatgagaatgtaagatacacattgaatgataaatgtgtatgaattgttcattgtgccttaggtaagccagacagtgaaattaaatgtgtaatagttgtatttttttgcataatcttggaatgtaattagttaaaagcaaacacttagattttgaacatgaatctgttaagcttgttaatgtagttgctgtggctaaataactggtttcctggggaagcttctatttgctagaattttattctggaacagttgttagaaaggaattctcaggtcaccttttaaagatatacacaattctgtattcactttttgagtgcataagggtaatagaaaatgacatgggaagcgttaattagaaaaaaaggcattttgtttatgtgcatttgaggatacagtgtttgaagtttctaaataattgttttatgacattttcttggtacatagatattgctaacaattagtttgctgaagtatgtagaaacattttaagaaatgattttagaaatataattgttaaagtacctctgatgtatattaaaaatccttttattttggtttatattgctatggatgtttttctgggggaacttaatgtatacaacttctaactaagaagttttattaatgctgctttatgtatgaaagtcatggatgtggatgttattttgtcagtggtctttctgttaaaatttacgtggtgtaagattttcttttcatgatggaattgccaaaaaggccagcctctagaacacttacatgttaagggttgggtgggatttgtattactttgtgtatataaccgacaggattgtgttactgaatcttaaccagcatagagatggctgacattttgcattttgggggacattaaattgttacacaatgatgtcattggttactgataggagtgtttagactcttagatggctttgttagtattaggcaaatattagatgtggatttaggagataagagggtggggtgttggagccctgtgtgcacatgagcatatgttgcagggcctccagacctaaatccacgtgaagatggtggtggtggtcttacctatatgttaacattacattgtaaacaggtagactactttccttttgctagtgggagtgttaaatcacctctcagaacattaattcattaaattgcccctaaacattaattgattgctggtggatatgctaaatatttttaacatctatttttctaaatgtatagatgtcatttttaattcataggggatagaaccagttttgcttgcaaaaagcaaactgttcactggatcattgggcttaatttttaggttgtggtagatataatagaaatgttcttacaatttgtagtataatactgtatatctctataaatatatatgtgactgtttttctgatagatgcaacatggtggaaatgtcatcataaatgtcggtctgcctttgtttatagttttcagatgtgtatatgcagttttttatacaacagaaaaattgccacatgagtcaaatagcataggttagaaaagttctcatttgccaaaaatatgtgactttcataatagtgagttgtttttgatttaaaatgtttctatctgtagaggcattttataagtttttatggggatactagcaatgggatgtgaaacctgagttcattagatcattgggtgataatggaacccttatgtgtatacaatatacatggttatatgttttttaaagcataggagctattatgtctgcatggttctaaatatatatacacacacgtaaacacatatctatatatctatctatatagatagatagataaatacatacatatgtagtgaaagcttttgtttcctccctcacataggcagattatttgtgtgtgtaaatgagcagctgaaggggaattttgttacatgtgtataagacagtcacaatatataattgttttgctttaattgtttagtctttgatttgtaggaattgccaacacgtatatttgtgtgtatgcaggtttatatataaatacatatcactgtataaacaacatttattgtcataggatagaaatattcttaagttgccagagatactgtatggctgctaaatgtatagtagaaaaatgttaccttttgctttttagcatctgcatacagattactaataggcgtatattgtgaccagtaaaccactagacaagggcataaacactttagtttgatcagtagaattgctatgccatgtttaaatgggatttatttggttgatgcagaatatataattgtatctagaagataaatattacaaaaatattttaatatacaatttctgtcatatttttggaaatatatttttattcaaaagtagaatcattgttgccaatagagttagcatctttgtgtgcttgtgaggtttgattttgagggttttcttggttttgttttgggttctggagttctaaaaaatgagattgtctttgtctaaacaatttttatataaaaatgtacatttttgtattattttttcttattccaacctaatcggtggcttgtcccttcctgtgtttattgggctgttgggtgcctggatagagctggagaccatttaactgctgtatgaataatagataagcgtcttgaataacatctgaatttcctaggtatgtagaaacacccaccatgcacatatatgaacatacagaatatatgaatgttaaaatatggtgaaaacaatcttttgctaatagaagtgttaacctttatttttaaaaaaaatttggtgtgtatgtagaggtttatttgattgttagttgtgtccatgtataatatgtcatctacctttacagatgtgcagaaatttgttgtatttggtggatatattttacttaaaactatagggcagaagctttttatgtttgttgaagtgaaatggcataccaaacctgtgtggtagagtgggatttttagattgctgtgtgtacagtcaggttatatctttaaaatacctattcgttatatattaatatgtagacattgctgatacatatgtatgtaaaaatcagagtatttttattaatataggcattagcttcttgattcacttgtttgttgggaagcacttggagaaggatgttgaatactttgtcatttcatctctgtgacgtacagttgtcatgtcaaccctcctatctgcgggttttgcatctgcaagcacatgcagctggaaagtacagcattggcagaatctgaaacccgagtaaagagcacctcattttcataaccatgggttctgaagagctaagggagttgaggatgcaccgattttggtatgggggtacggtacaggtacaaatccccgatggatatcactagacaactgtacaatcctctttagctttttttttgttttatagacagtgtggacgtgcatatattgcaagcatcactttgttaaactatgcttaaccctgcaaatgattttaagagctctgtgtgggtggctttcttgggtttactattaaatatctgtgtttatcatagttgttctataacatttcaactttgtaaatatgtagtttgttgataaagaggatagagacatttttcttttgttgatagattgttctttcccctttgcttagtcttcattgtgttgctgggattgtaaaagacaaattacttgcacatatttaagcttatatattaaatgtatatatgctgtcatgttagagagggagagtggttccctcccccacattttgatttaaaagtaaaaattaatttttattaaattgtttgggtcagtttcatgtaagaataatctctacattgaatggtatatcttggccgggtgcggaggctcacgcctgtaatcccagcactttgggaggccgaaggggccagatcacgaggtcaggagttcgaaaccagcctggccaatatggtgaaaccccgtctctactaaaaatacaaaaactagccggccgtggtagtgcacatctgtaatcccagctactcggcagtctgaggcagaagaatagcttgaacccaggaggcagaagttgcagtgagccaagatcgcgccactgcactccagcctgggcgacagagtgagactccctctcaaaaaaaaaaaggtatatcttattttctttgatgtactgaggttcatgatgcaattcattcttaagcatatactatagaatctttaaattatatggttctgtgttcatttgtggcatgacagtaaccaagacaatttagtaaataatcagcaaatgaaatatttaattttgaacatctagtatttctagatgtatagagagtctcacgaagtagattttttaagtatcttgttgtaaatttgttagtactgttgtcttttgcaattaatgtggcaatgaaattgattattgatacacaggctcttggagctaaacaaaatttatcgtgttttaatttggatattagaaggaggaaatgaaaagagactctctacattttacctgttattatatagcttaccattatatcagatatgaattgctttttttaaaaaacttagattaaatgtcatgtaaatgcatttagtctttccagatacacttcttgatatcataatttttatttcctgttaatattcaagatataaatgacttcattaaagagattttctactacctctaggaactatacaatattctgtatgtgttcccttggttgcatgacaatattcaagacaactttgtaaataatagataaaaaattttaatttttaacatctagtctttctagatgtatagagtctcacaaagtataattttgtaaataagtcattgtaaaatttcatggtttcattgtgttttgcaaatgtcttggcaaagaacttgataaaattttgggcttcttgacctatacatattttggtatctctttattgggttgtttagtgtaaggaaaaagttgaaagaatgtattttcaactttgaattgtaatcagaaagaaaatatattttaaccattgtttagtgcttctgttatatattgaaaacttcagtcttaattttttagttacattgttgatagggcattatataaatatacttctatagtcattgtaggaaatgtcttttataaggaaatatttcttctacctctgaattacacagttttgtatttacttggactgcatggcaacattcaaaaaacactttgaataacagataaaaatgacattttctaaagctctaggtttgctagatgcatgaagtctcagcaaagtataaatttgtaaatatttcattgtaaaatatcataaattgactccttcaagtgttcagtagtacaataggtaatcaataattggcctcttgggactgactgtaacgttttggtgtttgtatgttttgagacagagcaatagattgcctccatatcttttaaacattcaggtctcttgtataagaaaaataaccattgtggggtttttgtgcatcttatactaatatgaaacaaacaaaaccccctggatattttatccttagaaagatagaggaagacaggagaagggaatggtcattgtaaattagatagatatattgagtgttagaagattatttaaataattgttcttttgttatttgtactctttgcaaatttatttaaatgcatattcatgtatatcataagtatatattcacatgcatgtctaaatttagtggcatagatctatctcaggggtattaatctttcattcgtgtactgatttgtgttttattttcatttaaaaaattgtggaaccagtggctgggcatggtggctcatgcctgtaatcccagcactttgggaggctgaggcgggtggatcacctgagggtcaggagttcgagaccagcctggccaacatggtgaacccccccgtctctactaaaactacaaaaattagctgggcatggtggtagatgcctgtaatcccagctactcgggaggctgagacaggagaattgcttgaaccctggaggtggaggttgcagtgagccgagattgcaccattgcactccaccctaggcaacaagagcaaaactctgtataaaaaaaaaaattaaaaaaattgtggaactagtgttttatttctaagcttgcagatatttctagaattccacttactgttacatctaaatgtatgctgatttttcgttaaataataagcaggtctgtaaacattttcttttctaacctctttccatatttatatgagtatagaaaaactgtggttatgaatattttttactttttgataacttttaaaaactatcagatatgtgataatcagatagatttcaagtttacttacggtgtaaattaggaaaatttttataaagattctatccagtattgatcaaaagtataaattgtgtgtctttttaagcagcagtttggcaatgacaatcaaattgatactatgtaaaagttttgaaatgttatagctggctactggggtttttatctattccagttctcgaaaatttaccaaatataggttggctgtaaaatcataactatctgaggtatctgtcaataaatcaaagattgcaatgatgatagcttctttaacatgaatgtaattctaacagtaaaaaatttctatatggaatatgttttgtagtcctaaattgatattttatatcatttttcagtgaacaagtagttgtttacaggtgtctgtgcatatgtctcaagtttttctaactaaaatattaatagttaagtctaaaaatatgaattatacgtggggcttgtcattctgacatttaatacttcagcgtggtgataatggtgatataatatactgtttgaaattgtaacacatgagttaaaatcaaaagattgataagtacatatttgtatattgctacatgacaaaaatctaggaagaatatgattcacatgaaaattctttggaaggacatgacagacttttaacagtcctgtatagtgaaaggagaatagaacgactacttctactttctgtatctgaaattttcaaaagctatttcaaaatgaacatttaaacaacaggaaattttagagacaaccactttgtgcctgtcttcatccttgacattcaacatcctaggaacaatgggctgttgtattcaacttcttattcccaacagccattatgaatggtttttgattgatctcacaaagagcatgtgctttagacattaatgcagcgactaccatgaaacagagtattggattacctaaggaaagaagcagaggatggaatttgaggtaggtgtcaaacagtgaaatttcgtttgagaaacagatgagtgaaagaaaatagtaactgaaacattcattctataaggagagtacattttaatactggcgatgctgtatttgtgggtactgactagatcaagatgttagaggaggtgtctcttgggataagttggaagttatccttcattaatttggtataaactgaaaacagattgcttctttccttttaaagtggttgagtctctgatgggtttaaagtaggcctttggggatttatagatcattcaaaattagcaggggaaattttaaatattctctgcatctttctaaaaggtgtggtttaaagttggtgagaaagtgaaatggttgctggttgaacttgattttctctattcactatgcctggctagcctaaaattatcctaatgggtatgttcaggtgcctgatttgtatctaaatgtttctgtattggatactgtttttcttaggcaatcaggatgagtgaaaaattgatttgcagctgacctgcaaatggaatcatcaggaacatccctttctcatggagtcccttaatttacaagttaactgcaaacataggtaagaaggttctggtgctatttgggggtgaggtattggtgaggttttgcctaagctcaggaaaataatactggtacaggtgtatttcttggccaccttggaattatcaaatgagttagtctttaaaatatattttatcgaagtgaaggtatagtttggttcccagaccaaactgagggtcgggctgctatttctcgtgccccaataatgagatgcagatgaacaggggaggaagagttagagctagttacaggaagaaggcctggaaattgtcaccacaccaactcaaaattacaaagtttttcagaacttatataccttctaagctatatgtgtacatgtaagtgtgtatctaaagacataagtgatctataactaaggtctgagtcttcgagaccttcctttggagcctcagtaaatttacattaatttaaatgggtctgggtgctgaggtgattaccattatcttgtttcctactaaatcatggaggtttggggagttcctttagaacccccaataaacttgtttgtggaggcctggagagtttcttcagacccctaataaaacttgtttaatcgtgctttaaggttcaagagaggcctaggtaaaacttggtgggcttttgtgacattccaacctttgtataacaaaatggctctttcagcttttagtatttaacttaaccactccgtcaatactgaaacagttgttatggaggcctccattagagggacctggcctgccacaggtgcgcgcgcacacacagatgagagtacctttaattagtttacttatctatggtcaaacacgacaatataactaataaaagaaatgaccaggcatctaattactagaaattataaaattgacaatatgtgtgttttcataaatgtacagttttcacaaaatgttttcacatacagttctttgataaagggtgaagttcatggaaaccacagaaagatgctgatactgtaaactattaaagtcattactgaggttgtaagttgactttgctataggattgataatgggaagtgtttctaaatgttaacataacctgtaataaagttcaacatgagcattcacttaacctgccgccttagctgtttcattagagtggtatatatctcaccttacagtgtttcttctttttccttgtcaggagatgatagttccaagaaggaacattttatcgtctttgtttttaatctcaagaatggtacctaccatcagtgaatgacctgttgcagtgctttcattgaagtgttcttcgttccctcagcaatatgattgtaagggcagttgagtgctaacttgactgggagaggggcggtttggttagacaggacttgatatattctgtttttcataagcttgatgtttttttctggcagctacttgacattcagatctgattggttacatattgctatgtaataaattatcctgaaacaggggcataaacaatattgttatgtccatggattctgttggtctgaccatgcccaggacagtttaggaattgtatcctctccaaagtttcattgtagcttctgtgtttttagtatagttactatttctttctcatcaaatagactgaactccttttgttattatcatttaaatatttaggcattgttgtcatgtatattgtgcataaatgcatgtatactgcaggtaataattctgtatgtgaacaagtgacctagaggtaaaggaatccaaatacagagacgtgtggataatgtgggagaggtcagtttttcacaagacataggaaagaggctgggcgcggtggctcctgcctgtaatcccagcacgaggccgaggtgggtgtgtcggtcacttgaggtcaagagttcaagaacagcctgaccaacatggtgaaaccccgtctctactaagaatacaaaattagctgggtgtggtagtgtaatcccagctacttgggaggctgaggcaggagaatcgcttgaacccgggaggtgaagattgcagtgagccaagatcacaccattgcactccagcctgggcaacaagagtgaaactccatctcaagaaaaacaaacaacaacaacaacaaaaaagaaggaaagagctaacatctgacctcctttattattagaatactccaaaaggaattttgatccacatgctctttcttcataatagaatgaatgttgcatgtcattttacagacaaattttattagttcttgctgatgatataaactttgcttctaaccttttcccattttcccaactgtgtctctcaggtgatgactgaaaaagggaaactgtgccactatttgtaccatcattttcaccaaaatctaaaaatgctttttatgacgtatggagacattcttcatgtttgtttcagtggacactccttgcagatgtaaaaaactgagaaaactcacttttggaaagtgacctaaagagtgtcattgaagtgaattttaagtaggcacgatgattgttttcatggttgctgttggatcatatctcaggagctggaatgacagacattattgaacaaagaaatcaggatagtggaacttaaagggcttcatctcagtgctttcataagtatgaagtgcatatatttataattttcactaatcacagggtaaatataaaattgattcattaaaaatgtttcataagaattcaaaggacatagaattttgtgaaatgtagtatttttacttaagtgccttttctctgcttctaccccacagccaattttttataaaccagttgataacataagtagtttttgggggatgatacattacttatacattttctatgtagtaaacatgtatgtgtatgtgtgtgggtgtgtgtctaattactttgttggacagattcctgtggtttggaactgctggggccaagtttatacaaaaatctacatttttgagtaaactccccatgactctagtaagtttccacagtatttgagtattctttatttcctaaagctgtacaaacatcagataatcaatatttgtaaggatcgataatataatttataatgaaattgctttatcagctattaatgttaactacatcatcttcatatagccttataactcatttgtgctattccattttcctctgttccttttattttcacttcccttgtaatgttagtctctttgtactgatttctgaagagttcatttatgattaaacatgttaacattttgtctagaattgcaaatatgttttttctcattcattttactatggtgttttattttttggttatacagaagttgtatattgaaatataatcttgttctgttttatgactttggagttttgtggttttttaaaacatgtttacattggtatcatttatttgtattgccttctatttcagcagttagtttgtcatttctttttccattaatcatcattctggtgttaatgaatgcattaaatatttaaagtactcactttgacccgtgtagttatctgttaagttctaccataaagaaaatttccaggtaaaattggctacatttctgttaacttgccttaccattttattgacactttaataattactaatgatttatactgtcttatctattccattgagttctatctcatttctcttctttttcagaatattccctctgtatacttgcatttttttctatcaattgacgcttacaattatttttgcaagttggaaaaaaatgcagtattaatttcatttgcaacaaatttaatagattaattaggagagaatagatatctttaaaattgagtcttctgtccaactgcaaggtaggtctttctatttttaatggaataataatttggggatattgctagtgcagttttttaaagtattttttaatactaggcattttttagttatttgttaatttagtgatttggattagtcattcaacttgtctaattggtatgtgaaaactttttgtatgtcttttctagtaatctttactgaatttctaaaattatgactttcttgaacaatctgtcattttaattaccttgattaaagtacatttgtaagtacttctaggatatatggaagtagaaagtatacttggcaattggactgttaattgcaatccccttaggtcatggttgtttttgttcttattggtattttagtaatcttttagaagaaagatgttttaccaaatttggtgacaggtttaataaaatttctttttgtatagttgaaaaacttgtccttataattattaaggttaaaattaacatattccaaaattgaacattattccatcccatgaatgaagtaaattatattttagtatatactccttaattatagttgttataatttcatttggaatttctgaaatgattcctaaacaaacagctttatacttgttctgttatcagaggtttttaatgttttactggctctttgaaaccattttgagtatttctgacacagactagaaacaagtaatatttttctttaattattttgaaatgttggcttaaaaaggtgttgaaataatagcgtgtttttttttttaaagttatttatcttttgtccaaaatcaactaagcatttatgcaagcatgtgttttttggaacccttttttctgtttccttgttctttgtgtttttctttatgccaatatcacactgttttgataattgtagctttgtagttaacattttgaaattgagaactgtgactcttccacctttgttctttttcaggtttattttgctcatttcagtcctttgaaactctgtatgagttttaggattttttttttaatttttgcaaaaaatgtcatgggaagtttactagggattgagtctgcacattgcatgagtattattgacataaacaatactaactcttccagtccatgaacatgggatgtctttttatttatgtcatttatttctttcagaaatggtttgtaaatttcattgtacaaaaaattttctttgatcttactggttaagttactttctaagtattgtatttttaaaatgctattgcaagtggaattgttctttgaacttcttttgtgaattgttcattgctatttttgcatgctgaatttgtagcctggtattttgtggaatttatcagttctgagatttttttttatgctcccaaggaaaattttagcccgtaataatttttttggagacatagtctcactgttgcccaggctggagtgcaatggcactatctcccaggtttgaacaattctcctgcctcagcctcctgagtaggtgggattacacgtgtctgccaccacgcctggctaatttttgtgtttttagtagagatggggtttcatcgtgttggccaggctggtctcgaactcctgagctcaagtgatcctcctcccttggcctccaaaagtgctgcaattacaggtgtgagtcactgtgcccgaccagcctataaaattttagtggatgccaagagagatacttctacttcttttctgacttgggtgtcatttctttctttttgttacttgattgctgtggcaaggatttgtaatactgtgttgaaaagaagtggcgaaagcaggcatccttgcttttgtaactgatactagaggaaatccttttagtgtttaacctttgagaataatgtttgttttgagtttttcatttatagcttttactatggtgatgtgatttcatctattcctaatttgatgaatgttgaattttttattccttagtctttgtcttgctttggtaagagggtaatgctggccccataaaatgtgttggggagtgtttcctccttgaatttcttagaaaagtttgaaaacacttgttatttgttatataagtatttatttgatggaagattttttttttttttttttttgagactgagtcacgctctgtcgccccaggctggagtgcagtggcgcgatctctgctcactgcaagctccacctcccgggttcacgccattctcctgcctcagcctcccaagtagctgggactacaggtgcccgccaccacacccggctaattttgtgtatattaagtagagatggggtttcaccatgttaggcaggatggtctcgatctcctgaccttgtgattcgcccgcctcagcctcccagagtgctgggtttacaggtgtgagccactgcgcctgaccggaagatttttcattaataattcagtactgttaatagtttcatgcgtgtggttttgttttggtggcctttagtttcctaggtttgtaggaatttgtacatttcatctagattatctaattttttaacattcacttgcttatagtactcttacaatctcttagttctgtagactttatgtttctgatggtagcaatttgagtctgccctctttttttctagtccacttagctgaagctttgtcagttttcttgatttttgtttatgaagaaccaagtggttattttgtgttcattttctgttttattcatctctatatcattctttatgtccttccttttcctctttgtgtttactttgcttgtgtaattctttaatttgtacagttggttgatttgaaattttttttcatgttacattaataggtgtaagattcataagaaaacatgttttattttcattttcattcattcccacatattttctaattttccttataacctcttggtgtactagttgtttgtgttttctcatgtccacaaatgtgtgacttttccaaggctttccttctgttactgatttctaaattcattgtcttgctgtggtcagagaagaggcttctttttctgtctgttttttcaaaatttattgagactgaatttgtgaattaactacatttgttgtgaaaaatatctcatgcacttgaaggggagtgtgcattttgttgttcagagattgttgtgtgcatatctgttagatataattgatttattgtgatattacacacttctattttctctttttttgtggggtgaggggtgagacagagtctggctctatcccccaggctggagtgcagtggtgtgatctcggctcactgcaacctctgcctcccagattcaggcgagtctcctgcctcagcctcccaagtggctgggattacaggtgcctgccaccacacctggttaatttttgtatttttggtagagacagggttttgccatgttggccagggtggtctcaaactcctgaccttgtgatccacctgcctcggcctcccaaagtgctgggattacaggcgtgagccaccacacctggcccacacctctattttcttgttttctggttattctacccatcattgagagtaggttcttgaagtctatatttcttagtgaggaaatgtctatttctcccttcttttatgtcaatttttgtttcatatattttgatggtttactaggatcataaatgttggtcatctttatcttgtaatttttattaatgtataatgtacatttttgtttgttgtaacattttggattaaaagtctgttttgtctgacttaagcagtctacaaaataactgcttctgtaacaccttctctcctacccctttcagttgatgctacaaaattatatgtttaacattgtgtatcaaaatatatatatatatttgagatggagtcttgctctgtcacccaggctggagtgcagtggcgtgatctgggctcactgcaagatccgcctccagggttcatgccattctccttccttagcctcccgagtagctgggactacaggtgctcgccaccacgcctggctaatttttttgtatttttagtagagacggggtttcaccatgttagccaggatgatcttgatctcctgaccttgtgatccgcccgcctcggcctcccaaagtgctgggattacaggcttgagccaccacacccggcccaaaatatattttgtaaaatttattttttgttaaattttttagaagataacttgtagagttataatcaaagttacaataatatttactggttttttgcctaatgtgtggttttataattgatcaattcaagtcatgtagaatctaaaaaaggcaacaggctgggcatagtagctcatgcctgtaatacccagcactttgggaggctaaggaaggaggattgcttgagaccaggagtttgagaccagcctgtgcaacatagcaagaggctgtctctacaaaacaaattttaacaacaaaaaatagctgggtatggtggcatattcctgtagtcccagatactcaggaagctgagatgcaagggtctcttgatccctgaaggttgaggctacggtgagccatgatgatgccactgcattttagcctgtgcaacagaatcagagcctgtttcataatgaaaaacaagtggagggacagtacaccattattaacctctcataattgctcaattatttacctttaaccacatctttatttctttatagggcttccatttactatttatttcaaccttcaggagtcttttcagtgtttctgtttggtgggggagcagatctaatgtaaacaaactcctgttgtttgtacatctgggaacgtatcaatttctcccttactttttaattaacagttttgttggatattagattcttagttgagtatttttttttttttagcacattgaatgtgtcagtccactaccttctggccttatgagaaattgactgataatccctgttacatgatatcgtttttctattgttgctttcagaattctttctcttttgctcttcatagttgaaagatattgtgtctcattgtgggtctttgagttcatcttgcttggagtttgttgaggttcttagatgttagaattcatgtctttcatcaaatttgagaagtttccatctagaatttcttcagatattctttctattgcatgctttctcttttctgggaatcctgcatcgtttgtattggttagcttgggtggtggaccagaagctgtttagactcttacctttcttcaatattttttctttttgttcctcagaattgataaaattctgaagtttgctgatcttttttgttgcctgctgagataatgcatttgaatccctgtagaaaatttttcatttcagttaattgaatgtttcatgttccagaatttcatttggggttcctttttgaaagtttttttatttttgattattgatccttccattttgctcatgcatcattttcttaaccttctctatcacttcctttagttctttgagcaactttaagacagttgttttaaaagctgcttacctgtcttaccatctttgagatcagaagtggtaaactgatgagagcacagcctctcaatgtttgtataacagagtggtgtgttttgttttttgtttatgcctaccatcactccttctgcaagctgtatgtaagttgtccaagaaatgtgtacagctaccttgcgtgagggtgtaggagttagggataggtaatttgtactttgctaagagttgatgttgagtgaaattaacctcaataaatctgaatttagggttaatacaatcctccagagttccaaaccagttatatcataccgattattctggtgtatttatcatctcagggggagaaagagttctgttgcgtcctgctctgccatactcccagaatcctcagctcaccagttttttagtttgtttgttttgtttttgtatggatacagtttctcattctgtctcccaggctgtagtgcagtggcactatcatagctcactgcagcctcgacttgttgggcccaagggaccctcttgcctcagccttctgagtagctgggactatggacatgcccgaataatgtttcttttttaaagagatggggtcttactacattgcatagcctcatctcggagttctgcactcaagcattcccccagtctcagcctcacaacgtcctgggattctaggcgtgagtcactgtgcccagcttgttttacagtagtgaaatgaatctgcccatttatactttctgattatcaatgaaagttgtgttctataattttgttgcttttcagttgtgatagtttatgcatcacataaaatttgccatattaaccagatttaattgtactactcattagcattaaatgcactcacagtgttgtgtaactaacaccatattcaaaacttttgtcatcttaattggaaactctatacctgttactctaatccctagtcccttgtctccccaatcatgttttctgcatttgattttgcctattgtaggtatttcttacaagttgaatcacatagcatgtgttttttggttcctggcctattttacctaatgctttcaagtttcatgtaatacatgagaacttcatttcttattatgaccgagtaaatccattttgtgtatgtatacatgtgtgtatacatgagtgtgtgtgtatacacatataacacaatttttatccatctgctaatggatagaattttaaatctattcctctgctaatggacattttatatgccagtgctcaccaaaacattcacagtgtccattaagagatgaatacatttaaaaatatgtccattaatatttgagtgagcattggcatacaaatatctgagttcatgtcttcgtatctgattatgtatataggggaatgaaattgctgagttatgtggtaatttaatgaactcactttttgaggaaatatttgttatttattatgagaaattgaagtcaccaaaaatgagaactgaataatgaaccttctcatatctagcaactagagttaataactatgaacattttgccatattttgaaaattacagttaccatggtgatttaatcctgaataggtttatatttttatgtatcaatttttaaaataatcacaatatcctatctctacctagtaaaatttactaaaatcccttatgtgtcttctaaacacacaaagaaaaaacaattctcatttaaatttctcaaggttgtgcatggtgtctcaagcctgcaatcatagcatttttggaggccaaggcattttgcttgagcccaggagttccagatgagcgtaggcaaatagtgaaacctgttttcacaggaaaaaaaaaaaatgaggtatggtggcatgcacttgtgaacccaattatttcagaagctgaagcaggaggatcacttaagcagtaggctacaatcacaacactgaactccaggctgggtaacagagtgaaacattggctcaaaaatataaaaaattctcagttgtgcgaatgatacaacagttttttgagcaaatctggatccaagtgagtaattcacttttatctaggctatttttatgttagtcttgactgtattaatttatattcaatcttaaatctctcttaattaaggtatgaaagtcaacccttttttggttctatatttaagtaatttttaaaaaaatcttgaattaaaaacattatttagaagtaactttcatattctactggatttcttatttgctggtttttttggggggattgattctaccctttatttttagtattctgaatgagttttggtgagctactgtggtccaaaatatatattgtgtatacacaatacatagtctgaattcttgtataacaaaagtacagtccatatttgtaaggggtgcttggaaaggtatattaggtatattaccttacatgtgtagatcttcataagtaatagttggcaaggtctgctataaacttgttacatatttctatatttgtcattatattagagacatttttagtctttgatgttatttttcccattaatatggtgtcctgacctggtcatgctttcagtttttcatgagatcatgctaatgaaatttcttaaaagttttgcaaatataatctgataacgtactttgattttttgaaaaaaagtcatctcttacccagtaaatatcaactaattgctggttttcttttgtgatttcttctcaatgtattttatattaaggtttggagataccagtccttttaagcctaatcctcatgctatctggtaaaaattattaacaactaaaaattacttaatgtatattacaaaggaggtagtaccatctatgaaatctttttgataaatcttactccactctgtcttatgtatgtttaaatgagcaccagaagaattatgcattacatttcatttgattggttaatctttgagctcttggtttttaatatttgtttcttgctgttttctctttgaggaaatgagttatttgcgatataaaactttcacatttctacattgtgcccatagtaggatgccacccctgtggtcatgtttaatagttttttctcagtgtttcggtgtttaatattttctatcatttttttaaaaaaatattcaacattgagacatttttctcaatgtattatattctcaagatctgattttttgtctgactagttttatcaaatcattaattcagccatttattatatgaacaccttttgtaaaacagaagaacactaatttatcatgatattttcatatatattttgtgatattgagaatcattaagtattttatcacctgctttttacaaaaacacaatagtctctcatttcactaatagttatacatttgctctaagtatcagtaaatttactctgaatgataagttcttcatttaaataggaacttaatcaacttttttgggatttcagttcaaaaggaaaggtaaataaatgttttttcccttatcttaccatttatataataatgaattgatgtgcaagtaatcttcaaaggtgactagtttttaaattcatgttctttattcagaagacagaaagcattttcaggagatttgaatatttgaagttatattttaaaggtgataatgctaatagcataattaaaaaacagtttctgcatgtaaacacatggtagaatataacaggtaatatatatttgtaattatttttctatttcatgtttattcaaatgtatgtacaatctctgtagcttgtagtttggctgtgttatgctttataaaatttatttatctgagacagggtctcactctgtcgcccaggctggagtgcagaggcatgatgtcagctcacagcctccacctcccaggttcaagtgattctcctgcctcagcctcccaagtagctgggactacaggcgtgcaccaccacatctgactaatgtctatgtatatattttttagtagggtcaggttttcaccatgttggccaggctggtcttgaactactgagctcaagtgattaacctgccttggcctctcatactactggaattataggcatgagcctccacacccggacataacatttattttttattttatattttatattttatattttattttatttttgagatggagttttgctcttgttgcacaggctggagtgcaatggcacgatctcgcatcaccacaacctccagctcccggttgcaagcgattctcctgcccagcctcccaagcagctgggattacagataagtgccaccacgcccggctaatttttttatttttagtagagtcagagtttcgtatgttggtcaggctagtctcaaactcctgacctcaggtgatttgcccgcctcagcctcccaaagtgttaggattacaggcatgagctaccacgcccggcccataaaatttatttttatcccagttgtgtgtacttatttacttatgtatttatttatatttatttatttgagatggagtctgactctcttccccagactggaatgcagtggcacaatcttggctcactgtagcctctgacaccagggttcaagccatcatcccacctcagcctcccaagtagctgggattttaagcatgtaccaccatgcccagctaatttttatattcttagtagagacagggtttcaccatgttggccaggctggtcttgaactcctgacctcaggtgatccacctgcctcggcttcccaaagtgctagaattagagaggtgtgagcctccataaggaatatgatttgaagggaagaggggatatgagtgtgaggtaaatgttttcctatttaaatattgaaatataaaaggctattcagtttccattcaagtaacatttggaagctttttatttcataatactattttgtgtagaaaccattactgtttgttttgtatttgtgtaggtaaaaagtattatgaaattatgtaattacagtattcactctgccaaaaaaaacaaaaataattataactcgggtatctaatgattgaacatttagtaattcttccctgacaaaaagagaaaaatattataactcaggtatctaatgattgaacatttagtaattcttccctgattataaaagtagcacatttatactttggaaaataaaacagcatgtatgggaaaaagtaataaacatagagaaattccatcacctcccttcccctctcctccaagaaaaagtggcttacgcctgtaatccaagttcttagggagccagaggcaggaggatagcttgagcccaggagtttgggacttgcctgggcaatatagcgagaccctgtttccccaccccacccccccaaaaaaagaaaaacgtaattccatattttacaggtttagtgttgacttcataaaagatggaagggaaggttatcagagtatcccattgtagtgattatagtgctcagattctagctccatacctgttagaacacattcgcaattgtcagcttaaactatatttgtatgtattgtttgtctgttttgtattaaaggcaaaagctcattatcaattagttgtatgttttaaagagttggccacaacatccatcataagacctatctaaagaggaatacatgatgtcttagtacaaaggagtagagatacaatgaatgtatttattttcatgtttcttaagagggaatgcactagcaattgacggtaaaatagatacaaatcaagtaaagaaaccagtatatttttagtcattatgtcgctttgaacaacaatttgtttaatcattttgcggtaactggttgcttggaactgccttattttttgtattcaatatatttatttatgggagtgtatacatattccagggtgttctagttcctcagggaaaatctggatgacatagaagaattttgttctttattatgagtcaatttataatttcatctttttttaaaaggcatttttcctacagctagacgttttgattgtcacttttgttgtgagaaaaaaattacaaagacgttgtaaagattgggaatgaggaaggtgacttgatcgggtatcacagacttacaaaatcttgtatgtaattagagttatgttaatggcacatttataagcaaagtaatgtcatggaatggaagacccataagttgacatgagaaacagaaagtgtattaaagttaatctgcattcatgggggcagattgttagccaaatgaataaagaattagattcatcttcatggtatgtagcatgaagaatttaaaatgaatcagaggtttaaattaactgcagaaattatagagtttcagaaaacgaatttctctccaattttgaggaaattactgatgatacacattgtagaagcaacaagaaacacaaagattgatagtaaaaatgaaattacagagttgaaaaagttgtgacatcacataagaagagtgaaacccttggtgtgtaagatataatcggggaaaaataccagttcaaaggaaaagtgacttgagcacatagttcactgaaaaaaatacacaaagtgctgttaatcatataaaaggattcttgggtttgctcataataaggataatgacaattgaaaatacaactaagatataattagtttctctactattagactagcaaaagtccagaagtttgacaacatttttttttttttggcaacatgttcggaattatggaaaatcatacgttgcttctgggcatgtaaaatgtaaaccatatgggtaggaatttaatattttgtaaatttatatctgtggcaaatacatagttcatctcctagtaatatgtagcagtaagaaggattgatggatgtttgtataccactatgtgataatgtcttggatataatgtagaaataggggagaagtcggctacaggaagtaaaaatggcaatatggtgctcagggtgcattcatcactataacagataaccattttgttaatggtgccctgcgcggtaactgaaattgtactgggctttcaacagaattttgtcaaaatgggacgctgcatgagctaataagttgtgaaataaatagggttttattgtggagtaataagtaacacaaagaagggggtttgcagtatcttaggaagaagaacagacgttcttggtaaagttcctttaatatgaaaatagcatttttaaatacttggagtagtgagtgaagaagctttctctatgagagcacggttagttcccaaataaatcccagcctcctctcttctgttaatttcttcggaaggatttgaggtagcttttgaagtatttggtcaaagttgcaaactcctcgggaggaggccaggcatggtacctcacgcctgtaatcccagcattttgggaggctgaggcgggaggatcacctgaggtcaggaggtcaagaccagcctggtcaacatggcgaaaccctgtctctattaaaaatataaaaatgagctgagtatggtgatgcacgcctgtaatcctagctacttgggaggcttgaggcaggagaatcacttgaacccagaaggcagaggttgccgtgagatgagattgtgccactgcactccagcctgtgtgacaaaacaagactcctcctggaaaaaaaaaaaaaaaaaaaaggaaacctgagattctgcttaacaattgtaaagtcagaaggtatgaagagtatttgaagttagacctgtggacaggctgattggatcttcagcagtatgagaaagtttagttaagccaaggtactatgtaaaactccaagctgtacagagctctgcctggccagctggtcagcacttgggtaatgaggaattgataaatggcaaattgcttcattgaatgattggattaatagtagcatgaatggataaattaacgggaatgggtatataaatgggtatgagatcaggaatattaatggagtcacaagtagatgatgcgtaaatgggactatatgtgtggattgatggatggatggaccctgaaatgcatttttgatggaattagggaacaagaataaatataataggaagtgtggtatgcatgtaagcatgtttgtgtgtgtatgtgtatataggttgatgcaagagtggaagggtagtaaggacaaaaactttggacagctatattgacaatgcaaaataaaaacatgaatgtatgaatgtatgaatttgacggatatgtgcttgaaagaatgaagtcagtttaggaaaggataattaacaaatctcagtaatgattgtaatcatgtgattctcacagtaactgttcaacagtgactgttaaggatgctgcgtgctcatggcagtaactcatgggcagatgtcacaaagacagtaatacctcttattgcttttatgacagcataaggttttatttttcactgtggctttgttagagttatggaaagtcatccattgcctcttaaatacgtaatggtaaattgggtaaaggaattgggtaaatcacatggttttccaaaacttcaggagatttagaagctgtattttatgttttctcaaggaaaggatgaaaaggacacgttaaacactgatagtgtctactgtaggatacctttctggtctcacaaactaggtatactttctacttaaatggaaactatccccttcacagtgggaaccaataaaaacctcacccaggtaaaaatccagcgtctcagtgatgctatctccctatcatgaggtaattcacagtaatctgtaccttaagtctcagtgtacctactgttggcccagagataggtgaaacttaaagataattgtaccttggctgcatgtagtggctcatgcctataatcccagcactttgggaagctgaggcgggcagatcacaccgtcaggagttaaagaccagcctggctaacatggtgaaaccctgtctctactaaaaatacaccacaccctggtgtggtggtgtgtgcctgtaataccagctactcagaacgctgaggcaggagaatcgcttgaacccgggaggcagaggttgcagtgagctgagatcgtgccattgcactccagtctgggcaatagggtgagactccatctcaaaaaaataataattgaaccttatttccttttgtacaatgtacaatgagcagagtcagggcaactataatacaactccaaactctaaggtgtcaaatgtgatagaaatcacttttccattgaaattttgaaatccctctggaaatacactgtgaaggctccctatactgtgctagagagtgttttactagggcctggaagatgctcactttttccttgttttccttggctgtagcttttacctctggcacactttcccaatccccttatcctacttaattatttttaaaataggcattgtggaggatgtttgttcatattttaagtcttaatcatgggcttctagtttctttggaagtaaaagtgacccattaaaaatgtaaaatgtgttatgtgcatcatgggcacaggagtttcgtggcctatatgtgattctaacttatatcttaccatggtgatcgtagaaccatgtgttgatatgtaattttcaaaagaggtgaatgcccttggcacagtaatctgtcatatttagcaaagcttccctgagagccatcataacagacccacaggaatattttcattagtaagaagtagatgtgttcagccagtaaaattttgaagtggccatgacttcaatctgagtacagagggaaagttacacacaataattcagtgattggtggataggtgcgttcaaggaggcagggttggattggtgttttcaagcttggtagtagtagtagacaggcagacatgtgagttgatggaaggatgcaagaatggttactgaaattttctttgtattatatggttaatgtggatttaataactagtcattgaaattatgtgggattggatatttaaagcccagaaagatgaatataataatcgtctaatataatttgaaatataataacggatgcatgcaaaattgggtgtattgaataatgtaagaaatagatggaaagtagaatatgagcaaatggctggatgcaagaatggagaatgcaggttttaaaaacctgttgggtgtatgtatggttatatgcacagtggaatcatttagtgaaggtgcagatggttatatgcctaggtgttatcattggatggatcaaaaatggaatgctgtatggatagatctttagattgatgagtacaaatatggctatctaaaaccttggataaatgtagggatcagggttcaggtacattggttgcataagtgatagctgcctgtttggtggctttagagtggcttaatagactgatagatgggttgattcacaaggtgatggtacaggaatttgatgactatgagaatgggctgatgcaataataaagtcatatatgtaaagttgactggaaagatggacatttgaaagccaatggtatattttcacgggcagattcattatgaaattataaaagttttgtttttgcattctcaacatgatgtgttagcaaataagcaaaaactaactgcagtgggttcacaagttagtttaattaaaatgatctttcaatattttaataatttggggactttaggaggttgaggaatgagagaacttcaccttctgtatattaactggtcgtatgtcacaattttcccatatttttcacagttatagctgaggtggtaccagtttaagaagtgagaacttcttcactgactgaaatttgcatatcaatccaaatcattgtgcttatttactatttttgtagacgtcattcttcaaaagtgctggtaagaatcagtaaccctggtgtactgtttatttttgaccagtttgatattgaatctaatttgtaatattttaaaatccaaaactatacatgaattctataaaacacaaagttgtgaatttgtggagtgattatcagttaggtgaaataaaagagataaaagggctccctaaattttgacacagttttgatatgtagtttatgcaggttttgatttaccagtcttatctactctcaccgtagtatgtaatgtcatctggactgagactataactttttatctgtatactcagtaaattttatattatttcagtaaattttattgaataaatgctctggaataaattcatcagctagagggagataagaaggaagtctggcagcctgtggaaaataaagaaaatggataggctattaaaagatgtcagagaccaaagtcattaggaattagaatttactataaatagtatgggttataatgagagtagcaggtttaattttagttccaagtgcatgatttaggatatcatcagtaagtaggtaaggtcagcagataggagttgaggaatatttcaacattgaagtggtaaaagtagggtcttaacaccctttctttcgatgagtgaatgaaaaatcttcaactattttccaacattcctgtttttcttttttttcacaagcatcttcaatagtcaaggaggacaaagacatctttcctgcaggtaaaatcattaaagactatattgtgattttgaagctgttctatttgctacgttgaggatatattagattcttatttgagttctttgaaattaaatttcttttctcatacatcctactttgtggttatgtgattattttgagtcgatattttaatcaaggactttatagttaactcttgttaataaccaacatttaatgaaatcaggcattttcttgactttagtaccacgagaagttgcacaagaagcatacagggtagcaaggagaattgatgggtggatactgggttttagtttgtggaaagatcttaatggaatacacagagtatcttattagtatttccttatattgtgtcttttaaaaaaattcttaacccctgaattggtgtataaattagaatgaagaaactacacaggaaatgctggttcaaagaataaataggtggttggttggcgtgaaaataatttggaataggagataggtattcaaatcacaaaaaaatgtgtagagaaacgaaggaaaatggcagctttatcatttgcatacagtacgtatacctggtttttgtaggttttgggttattccacatcagattgtaggagttcggttttatggagtattacttgacttgaagatgatatatttctgtcaccaggcatggctgtgtcataacctgttgtttatttccatttgcaatctcttcttctgtactctctcaggtggtgaccatgtggataataggatcatagacaaatggtggttccatctacagcatcaccgaaatgctgttgttactgcttctttctgggatcttcttgcatctttgcttctaaaggggcacaccttttatagaagtacgtccaggaatagaagtgacctgctttttcgcaagtaattgcctggaatgtttttatgtacttctctgcactctcaatacatttcatgcttccctctatttttgtatattaactcattgtatttcttaaatttatattttactttatgaatggaagtgagatttgtgtatggtaaatataattaattcaaccccatggatacgttagtcactgtccagatgatggcaagtctttctcagaagcagagggccttggtgtgccagtgattttttttccccatgtgtaagatactttttttcctcatttgaatcaggagcccacagtttttagacaagtcccaaatgaaatcttaagcatttgtgttatctggactagaccttctgtagtatcctttttgttagacctagtatatctcattgcagatcaggatctgagattgactatagttcacctctttccaagtacacaaacttggatgacatgacaactgagtgtgtaagggagagcgagacccttgcactgccatttgagcccttgtgatctcatcttgtagaacatgttgtacaatcattttattggtatcattagtgttatttggggctggaataaaaatctcagtgcaccaaagagatttcccctttatccacgttaccctggttttcctttgttttctgtttaacctaaacgggcttaatataaaatagtgcttatttggtgttttaattgtctgcttctataacataagctgcactgtccattggggaactgctcaccatattgcccaacctgtcttgataggtttatacatgggaggcattcagtaatattaattacctctctagaccagtgttagcaataacaaacacttgctagaattttaagactatataatcaatcactttgatgtcagttaatcctaccaacacaagattaaaggtttaaaaatctcatacgtgtacagccattagtgtctcctttcatactatattattttgttcattggcagctagatttttaggtagaacttgtgttcctttttgcaatgctcatttattttacctggacagaaggtgctcttctgtctcttctccaaagttaatttatctcatactatttcttgtgttaatattttccaagttcagtatgctgttctggttataagaagatcagtgtcctaatcacacacttttacattatatgaaacatcatacagagttttgtagtctgtataacaatacacagaggtagcaaaatttgtaaaagagcagactatatagtccatactgtagtaactactcaacattgccattatacgtgaaatcggctataaccaattcataaacaaatgaatttggccgtgttctagtaaaacttatttacaaaaacatgtgttaggccagatttggaccacaggctgtagatttctgacctctggcttacagcagaagtttattatgatcctggggaaggtggatatacatggaaggcagaagcgagaagatgtattccatcccatgtcatttttctgaaccctcaacgtaggaagttaaactaaaacatggggcagaatctgctttaagcctttgaattcttggctcttaaagccaggttgagggttatgtgtttttattcttttatatctccttttcacttaggcttggcaactagttcattgaaacagagccaacaagaatgagtgagtcactcagtgatatgaagcaagctgtggtcatttatctactaccttccatacctacttcctaggtttgataagtagtgtttgtagtgtagttgtcagtaacttttctcagcttacataagtttatgtggaattcatttacaaatgtgtgattattacgatagatgttattttataaatttcaaggttctttaatacagcatggacatgtttctaaatcaataaatatagcttacccacagactttttatgggatgtaaagtatgtattacaacaggtaaatccatttctctgttttgggaaagcaggttaatgttttgtttgttttgttgctgcatataatgttgcactatatatatattctaatgcagttggtctcctaattctacaggataaatgtctagctgtggcattgttggatcatcagtttcgtttcagttagatgctgtgaaattgctcttgaaaatggtgtcctctgccaccacagaacggtgttgtaatggaagtgccaattttcataaaaacttgtgtgcaacaggtattaagaatttttgaggtcgggcgcagtagctcacgcctgtaatcccagcactttgggaggcctaggcaggtggatcacctgaggtcaggagttccagaccagcctgaccaacatggtgaaatcccatctccactaaatacaaaaaattagctgggcgtggtggcatatacctgtaatcccagctacttgggaggctaagacaggagaattgcttgaacccaggaggcggaggttgcagtgagccgagattgcaccactacactccagcctgggtgatgagcgaaactccatctcaaaaaaaaaaaaaagctttaaatttttagccaatctaataggtgaaaatggcatttttaacataagtctgacttaaacaattaatggccgtggctaaaagaagaatcaaataatgatgtgtgatttataagataaggaggcagtaccccatttttcctcactctacccaaaaatcctgtttatctgagcaagaaatcattaatattttctaaatccgcttggaagttcataaacgccctaagtataccttataccagcgtttttatgactttgtatttttgaaataattttagattcagaatcgcaagaatcatgcagagcgacctgatttacgcttcacctagattgactttttattctgcatcgttgtgttcttcccccacttcctcttcttgctctcgcctccctttatatgtttatacatagcattatcattttatgtactatttgaatgatttgccgacattatcttcctgtaacccaaaacacttcaacatctactttctaagagcctgagcatcttatattgacttcggtaaaaatttcaaaataatgaaatgtgtcaatagtataaaagtataacagtatgcagtccatattcacattttacccatttttccagaggtgttctttatagcagtttcttcccttctacaacatccagaaaaggatcttctattgcattcaattatcatgtctctttagttttgtttaatctgaaacagtttcctggactttgatcacatcagtgttcttaaaaagtaatagctaacagatttaaggagatacctcagattttgaattttgtgtttcctcatgaaaaggtttaagatactcattttgagcagaaataattcagtattctcagtcttccttagtgaatcatctcaggtgacaaataatgtcactttgtctcactttgaattactttgatctcttggttcgattggtgtccactggacttttccactatagttaacattccttcataattaatttggaactatacaggtattctatttttcatcaaacttccacatagtaggtttaatatgcacaggtgacttttacctgaatcagtgttgattagaaaaaaatctgttattgcttagatgcattatttagtatcttgtactgtaaggaagagtttgtatatcatggcctgtcagaacagtcccgcaatgtgttttatgaactgaaaattctgaaagaataaggtagtgatttatatgagaatacagggaaagggttacccaaagagtctaatgaatttatgtctaaaccatagagtggaatgtgagagacacacagaactccagagttgtgatgcaaatacactgcacagtggaaggagaagaggaagtttttggtaatagtgtttcatctaatgtagctctgtaatgtatgtgtgccttcattattggaagagtgttcaacagttcacagttgaatagactgaagcatgatgctggaatctgggttcagattctagatccgtatcctacatatcaccaatgcttgtttctcaatttttgtttgtcattactttaagtctctttaatgcattagagtatccaaggttgacagtgaagggactgcatttgggagctatctgaagacaaaaacagctttttgaagtttctttcatacgtcaccttacatggcctctcgcattctctgtggagaagtttgtgtagattattcagactaccgtgcagtgactgtgttgtttaaaacctatacatatccaaactctgttttgtgttctctataactagggcattagtctcccaatagtaatcctgcatcttatgctatttaaagaaggttcccagaatacagacattcttacttttgaacaatgacttgggtagattgaggaagtggttttaataatcactttgatatatttcaaaatctggttcattattggtgaggtgcaggccacctggtattaatgaaaatgtgtaattaggaaccagtgcagtggaatcagaggcttgaacatgacctaaggcttggtcaaaagtggtgatctgaatgttccctgctctctgtatgtaactttgtacttagtcttcagtggcagggttgcagcagaggcccagtaaatattgttcattcaacgtatgaaggagaaaatggaagtaaggccaaaaattactgattgtaaacaaatgaagcaccaagtgaataaatgtacaaatagacaagtagccagtaggaaaaaaaacaataattgttacctaaagaatgaaaaccaagtggaaaaggccgccagggacattttaatatgcatattgttgctttcacatataatacagtaagggagtatcagaaaacctgaatctgcctgactaaaacataccctgttccacaaagctatatatatgagagtattgaaggtggtttaataccaaattcaaaaattcagcctcagtgtagcaaacttttaaattttccatgatataaagtaagttttaaccaacaatggaagtcacagcactaaagtacattactattatatgattctctgatggtaatagaaactgtgctgcaggacacgttttgattcaggaagaaatgtggagtaactccacagaggaattcatcctttctaagtttaaatctgaacggaacccatatgcccataccctgaagatgcatgtaagggaacaacatggcttggtctgttgaaaaaagaaaagaaccttcaattaagcattctgtgaacttgataagaggatgcagaggaacgtaaatgcactctgcatatctgtgattgaccttggaacacagtgattgccctctaaagaatagccgagtaagtactgttatcattccaccgatcaaattagagcctcttccttccagtgggagcagagtgacatagaccaaggaaagccgaggagaagattgtagccttttatttctccttatatttgttgaggttcactgctgactgataaacgatttgcacaaaaaaattcaggcctctgactcttctggtatttgatttatctagtaaagttaattccaagacaaaagtacagttggttaaaaataccagtctcatgtttatttgatggtttgaaatattctgttacattgttgtatctcgtttgtcaccttggaatatatgacaatcatgttatcttgattttttccacaagataatttgattctaaaatcgattcattgtttatcttcaggaattagagattttaaaaatgtcatctcatgtctcattcagtcatttccaagatttagcgagtgttctccctaatgccttggataagaatgccttgttcaatggctgtattttactcataattagcattccaactgctttgggtttttttagatttacaatttttatttctgcagtacttaactttctatattttatgtatattaaaacaagttaggtaggatgaagatcactggatgatataaatactaatagcaaaagtagaaataagttgtattatataagttgtacataggtgttacattaggttgtcttacatgaaagtattacaaagtatgggatttggggtgtattttgaaatccttgccagttctacttgataaagtattgaatggtatcatgtgagaggagaagaggacggaaacaggacttatgatttagacctcaacaactgctagggagggttggttttctctgagtgcatgattttttataaaaatgctattttgccagttttagatccatattaaacccacagattaaggttttggtttttaaagtgtaaataggaagcttgagctgggggggaatttggaggtagagataatacttaatcgctgtgggaaaggatgagatctagagatagagtgtatgtgggagtaggaacatatgtgtctgagaccatgctttggatgctctagcatttagatattgagaaaatgaggaagacccattaaaggagattgtggctagagttactggtgaaaaccaaagggttgtagtgttcctgaagatacatgaagagtgagattaaaaattaatggggcagcagtggcttttgcatggcattgaaaagacacagttcaatttgaaaattgagtatcattaatcgtagtgctcttattattgaaaaggccaaatcaaacaatacctttgagttgatggtctgtactataattaggttaccattgttagcccagcatagacacatgctgatacctgtgagttgctttcatcaattagtatgtgaagatgcatcccagttgtacaattttagatcctcttcatcattccacattatatgtatacaagataaaacttgatgttttcattacatcctttcaatcttctaacagcagtccttacgtagctttatcattggagtttccacttgcagtgtctctatctgtacctgcattcattggccacggtagagttttcattacggcaggattgcatttcattgttttggcttgtgtcagacatttagcaaagattgttgaggaaaggaatggatggaaggggccagctgaaagaaaaagtaacaacctaatgatggataagtgaaaaaggaatgaagaaaggatggtgctaggaatcgagggagtaaagcaagatagaatgtacaaaaggtcgaatttttaaagaaagttgtagggcaagggcaaggtgtgttgaacctacatttaaaatacaataacatcactaaagtcgaggccgggtgtggtggctcacccctgtaatcccagcactttgggaggccaaggcaggcagattacctgaggtcagaagtttgagaccatcctggccaacatggtaaaaccccatctctactaaaaatacaaaaattagctgggcgtggtggcgggcgcctgtaatcccagttacttgggaggctgaggcaggagaatcacttgaacctgggaggcggaggctgcagtgagccaagatcatgtcactgtactccagcctgggcgacaagaatgaaactctgtctcaaaaaaaaaaaaaacccatcactaaaatcagggagaaaaaaaccatcactaaagtcagggataaagtaccattgtggaaggtgttcttttccagcttaacctgaagaattgtacagtcattgtacattgtcattccctaactaatgggttagatatgagtctgtagaaaattgtttgtccaacatactttatgcctcttaacatttcacttaccaaatttcatttcattccttcattttgtgtctaacagactagaaataatgagctcctattgacagggatattttcctcttcatactttcctttaccttacagagccttttatgtagcagatatttaatttcataatgggtctaaactacttgtttagaccatggatgagtgaaattttgatgaatgagccccaatcacctgaagggtgagtaaaagaagaatttctagagacccaatatgaagtagctgcttcacacttttttgagaatgttatggcatgactgaggaaatcatagatgctgtagaccatgttgagttggattgtgtaaatatagattctggtattagggaactcagcatctgctggattagacttcttatggtgaaagtctttttttagggattaggcataaatccccactgatatttgtgcagtaatagagtatagctcctgttttctttcctgcttgtatagcctgtgccattagtgtcctctttctcactgttttctcaaaggaaaacagtcaaagaggaagccatatgcatggtagactttgtaatccgggaaaagtcaacatatttcatagtagtgcactttttatgtgttgtcagtccttagaaaggattcattttctccatattatatactactctattttaaaaatttcttgggggagaatggctgtagacaggccaatgatagaatcatagaatatagtcactgtctaattactttcaatcaagagagggaacaataaagtacaatgtatgtcgctgacttcagtgtgaccactcagtatttctgtaacacagtatttatattgctgtacggtagagttatacttatttctgtgatccagttcatttgtttaatattgggattcaaggagtgttgaagaaatgtctactgattaataacagatgggaagagtgtatgtgttttaaataagagaccaagagagacaataaggaaaataagaaggaagtgtttgtgaacctttcacattactcttacattcgggaagtccacaagacaccgtagtggagattctgaggaggtgaaaacctgtagaaaaatgctttattagtaaggagctgactaagttgtcagaaagtgttgatttttagaaggatattgagacattgggtatatagggtatatgactccttgtcttcctttcattctggcttcttaccagctgttgtgaataagtttaagatttcttctgacgttataaacttcagaaaaggtatggctgtttgttcagtttgaagtagtatcatatccgccaaagccttgttcaattgtcttgttgattcatggttctcttcagtgataatattatatgggattcctacccacagccacccaatatctcagtggagaaatgcaggtttggagagaacatctgaatagaatcacgctaagatggtacatttgcactgagaccattgttatgtggcaggcagacatgaagtatcctaggattgatcagtatgccttaatgtaaatagctgcatatagacctgatttcttaggctccccacttcaagctcttgaatattgtgttgatatccttatcaatacactttgtcttgtgttctgtgttgtttttccaaaatataacgagctcctacttgacagggattttttctttctattgtcttacgataaaatgtcaagataaaaatgtatgagtttcattaaagtttattgaataaaatttgtgatggaatgagtgacagcgaggtcatgaatgagagagaatatggaaataatggagaatgtgatattctgatagtcatgcaatattctttttgatataatatgtaacatatattagtatgttatattctatgtattatttgtcatatattattactatatcctgttgctatatttggataatttgggaatctgccatgtttgatgatgttgaaaagagaacataaaatgtagtgatttcttaataaggtgtagaggtgtaggtattaactctttaagaatatagtgatttattttaaaataatgataggaaaggaccataaaaatgtctgaatttgggaaattagaaaatgttttctctctggggctttcatatgtctgttctatgtgaatgtcgctttgccatggctccctctttgctaactcttcttaacccctgcagagaaggaagtgtagtgatggtattttgagtccatcttcaggtttattgggaatgcaagggaaatgagttgttaccaatgggagtaaagggctagttgctatgccagtagctgctacttttgacactgcttgagcaatctgaatggctaggtttgaatctggcttctcagtcagaattttaccttcactctaatgctgctttttttcaaatcacctatatttacataaatatgaaccaacttcagtgatcttaattctttcccgaagatccaagtttctttccatctgcctgaagaactttctttagcacttctggtatagcagacctactgatgataatttttcttttagtatatggtgattagtttactttttattcaactgtgtctttttttgaagtcttcttcattgaaatatattgttactaaatatagaattaatggctttctttaagcacttcaaagataatccactgttttctggactccgttgatacttaagtctttatttttgtgtaattctttttctttaaatgtgccatttttcatttttctctgactcctacctactaagatatttttacctaagtattgagtcagttttggttatgatgtgactcagtgtgtttttatttatattgtttggttgtttgaacttcttgaatctgtaaatgttgtgctttatgttaaatttggggggatttcagccatttaaaatataacttttcagtctcttccccctgggactccaatttttacatatgtattagacctattaatatttttctatggatacctgacattctttttaaatcttatttttggtgtttttcactttgaacaacctaataatttgtttccatccatgttcactcactgtttattctattttttcccaatctgctcttaagcctatcctgtgaattttctttttaatttattttattttttagttccagatattttctgctttttgtttgtttttgagacagaatctttctctgtcacacagggtggagtgcagtgtcatggttcaccgcagccttgacctcctggtctcaagtgatcctctcaccttaacctacccactcctaagtagctagaactacaggtgcatgccaccacgctcagctaattttttatttttgtagagatggggtcgttgtgttgcccaagctggtcttgaactcccagactcaagcagtcttcctgcctcggcctcatgcccgcgccaaccagttctttatttttaatattatgttgtatttgatgtgctatcctattcatttagtataagcacatttttctttatgtcttcagcataattatatgctttttcagaattttaacatcaggactgcttccagggtagctttattgccctttgtcttaagtatggattatagttttcattctttgtatgtcaagtaattttggattgtaacttgaactttgaatatactgtagaaactctgaattctattttattcttctaaaacaatatttctcagcttcagcactactgacattttgaactgggtcattttgtttgtgttgttgtgtgtattttgggagggtactgttctatatgcattgtggggtactgagtattatcctttgtctccactcactacttaccagtagcataactctctctcctccccacatcccctgccaaaaaatgccttcagtcctttctaagcgctcttttttatggtgttggggccaaaatcatgcatctttactcactctttctcattgagagctatggctataaagggtagtgatacttttacttatttatttttaaggcaagcagttaacttagctggattcaaactccaggctgcctcgtgtgctgtgggaagcagcctacgctctattcagttcttttcttttcatattggttgggttactttgagtctggcctacatgatgggcagtttagaggtcaaccaaaggatttcagcagaacttatacacagaatttcattcaggcttcccgtgtctgattggctacagtgtgggaatttcctcccacttttcagccactactgaggatgcctttcggcaaaattccttgaaattggaaacttacagggaaattcctttcctccaagagtgcgctctcctccagtgttggcttgcttttggttgttctccgtggttttagatagctgtctttatattaattctggagtttacagttgatatctgttgggggcttagtttgataacatgtattcttctattactagtagccagacctgtatgtcttacttgacctgatggagaaaagtttcaacttatgagacaatactgtgctagctagttttactgatttgtactctaaagtacccaagcctaaaatagtagagctgtctatcccacatgaaacttctctgattttcactgttttttataaaaagtatacatgttcacatttctgtaggtttttttaagcatcacaatttttataaactttctatatttccaaggtctacctgctttgtattttgcctagtgagagttttgtattcatgtaggaataatctcttggtgtgagtatctattttccactcatccaaaacagatagagcattgatttcactaagcgttatgttctagtttgctttggtattattattagaaatacctggtgattaatttgagctaagtattcttctctaccctcattcccagcattatcacccgcttttaccacttccaaggggtggaagcattctccacaatgcattttttcatgccagagaaaaatctagaaaaaaatgaataaaacgaagaaattctttccccttggtatctgtagctaacttgcctaagtgttctttcccacagtttaagtcttcagtccatagttcataagcaaaggggtgtagcgagctctgatcttgccagaagagagaataagtgagctaccccacggtggacattctggccatctgaaatgagtcgatgcatgtggcttttgtctaaaggctacaaataaaatgtaaccactttcttctttgagtagttgatatagcaaatagttgaaacagaagttttgattggcaaatcaggatgtggtagatactttaacaaagagtagaactattaccagttttatgtgttgctgtttgtatctctttcacagttttgataatatcacatcctggaaagtgaaacagaaaattattattccattttaaatgactaaatttgctttcatggtatttacagtgaaagagtaaattagaaagtgaatggatgactgttcatgagaaaaagcagggtaaaaagattttatttaattaattgaaaatattagggtcaaaacataggcttatgttatgttttgtgaattgtgctgtgttgtagacatttgatgagtcctaacatagaattgatctagctcttgaaataccatttttgattgagtataaatgggatataggcaccttacaacttcagaattcgaggaagatgatgtgaatcttccaattttatctatttgattcaaatggtatgttttttcacatttctcataatttccacgtcaactcccatgatgatcatgcaggaaagcagcatgattgcacttcttgtagtgcataccatcactaaaacatagttactgtctttctgtggtcttaagaaaaattcagaaacagcataccaatgtacatataagataaataagcttatgtggtacagtaagtgttctgttctgagaaataccttgattcgtatcctaatgtctgatgttattggtagttctcaaacttccccaattctgctttcatctaaattcatcttatctatctattgttaaataatctatcagtccatttttatctatcatctatatatctgtctttatcaatcattcgtctgtaatctatctgtgccgtttggcataagagacagaagggcatagcagtggaaactcaaaggagttacctccatgtgaatggacagtggtgatggtgatctgtgaggtggtgatgtatagaaagaaaaactagaagagagcatgccctaactcagggaccttgtccagcaggcactctggccttgttatactgtgcttgaatatgaaaaaaaaaaaaatcaaaatagtgctgacattctttgtcttctgggtctgagaaaacttagagtagatatgatgactctgccatttcagtcttttgtatttccacatttagagctcagttttaattatgtagaattatttctccagcctgtgttaaactagaccatggattggcaaactttttttgtaaattgccaaatacacattttcagttctgaaagccttgtggtctttgttgcagctaatctactctgctgttgtgttatgaaagcagccataggtaatttataattgaatgagtgcgctgtgcctttcttccaataaaactttacaaaagcatcctgtgggctggagtttaccctttgggaaaccagagcattggctaaactggaacctgaaaaaataatcacatcaactcagccacatggtaataatatttagagtattatttcaacattttcattttcataaaaatttttttagctcttttgccaaattccatctgtgagtgatacaaatgactaccacgtgccattaacatcacctaaacagtgcaaaacaagcatagtagaagtaattggaatgatataaaccccttgctgtaatagttatagttgataaattatgtttcaaaattgaacctatttcttccaaatttcatctataaagttccaaggagttccaaaatcttgcctgccttcttttcccagttagcagtattgtctctgagcagccatggtggtatccatcctccttggacaatgaatttagcctattttgacttcatttgagcagttgtaattgtttcaccacatcagagtaagattactacatgccagagctattctttaactcagcttgtaaaaacatgatagcatcaacaatatacatagcaaatgaatgccatctttaatccaattaaatggtttttacaaatttgctcttgtttgttgatgctatctgcattgcagtaattaaaggtgaggtaaaaagaatgaataaactgccaagttaaaattaaatttgggcaatttctcttttgcagtaatgtatgtatatttactcaaaacatatgccaaatttagtgttgaaaggctcattcaaatcaattgggaaagcacgtaaatgaacaattcataaaagaaaagcattgcaaatggccaagagcatagaaaatgtgctcaatcttaccagtcattataaggaaataatgaaatttgtgtatatatgaaatacttaaaatatatataaaataaaacaattatttgccttttttcacctatcagattaacagattatatgtgttaacaaggtggggagaatttacaactcctgatatgttaaaatctttcaggaaggtagtagaaaatatatgtaagatggaaattagcacttttgaccaacaattttagttttagatatttacctataaggatataataggaggtgttcaaagatgcatgtaactcaatgtagtattaattataattgtaaaatagtaaataacatttttgtcaaatcataatgttaggaaaattagtgatggcacatttaaccaattgaattatattcagttctgaataccgtgatgcatgttcaaattaattgatacaaaaatccaacaactttagcagtttgtttaccagttattgagtaccaactgtgttcaacattgttatttcactcatatgaaatgataaatgtatgtgcgtgttatgatacggtcaataaaaccacttttataggaagaatactcacaaaatacagcgagttctggtcattattttattgttgcatttgtgtgtttgtgtgttttgaatacatacatgtatttcaattaactatagcatttattgaatttttatcacatgtaccagatggggagatcaacactttacatgaattataagttataatataataacttatataatgttattatataataacttattattataataacagatggaataacgaatttgtctttttaaaagataagtaaattgaggttgagtttgaattttgtaattcattctattatatagaagttaaataaacctatcctaggatgtcacaacctttggataataataattaaaaatacttatgatttattaaacccattgagcaaaatcatgttttgtgaaagaacccacatttcagaagtcatattcattcttcttttgtctttaaggccagagacatgataattattaagtgcagcttctcaggacagaaagtgtaagtgttggtatattgtaggaacaggagaaaaacatgaataggaacttgtcttttggaaattcttacagtataaacctttaaggagttacttctagaaatatggggtgcctttgctcaggatgtggaacaacatgttcccgggcagaaaccatattatacacaaagctctgagacatcatggaggcacagatgaaagtccaaagagaaatggccagtagaaagaggatcactaaatggaagaagctaactttggaatagagctggtgacaggtaatatgatgacttaaatgctgccaatagcagggaaaaggtccatggtaatatctgagtgaagaaacaattgccaactgatctagatttgaagggcataacctcttggaatatttttccagtgtaatttgtgatcatatggtctggattctacaaaatctcccccattctacaaaatctataatcagttctcttccattttcttcattcattctaacccttttctaaagacggcactttgtgtcttgtgaatgcaatcccttagcagttctcagctagtagctgaaactttggttaaaatggtaagcatgggggattgtgacataaattttgctttgctatggcagttattgaaatatttttataattttgactatttgtcatgtaaggaatgcacagtgccattctaactgtgtatattctggtatttggggggttggaaattgactatatgagattcttgcagctgggtctctgacatgttgagaatgctgaagaagaaaaagtacagaaggagaaagcagagatggggaaagctgcatccctcaaataggataccactggatactgagcagtgaacaacctctggttttgtcggacaccattttggaatatttggacacagtttccggaaggatgagagacctaatcaatggtagtaagatgtttaaaatattattaatacgaatgaatgcttaggcaaggttgacggtaaagctcttctgtacaataggtagcgttaataaagaaatgacaagatttggaaaatcagtatttggaaataatcataattgtttcagccaggaatcatcaaatgatgctaaaacttggagaaaattttaagagaaacaggacatttggtgtccttatcagttacaaagggaaagtagtagcttcctgatggagaacatggttgacagcacctgaattaaagaggtgaaagttaataccacagtagtgggaacatcaggcagcgctgataggatgcactgagaagaacacagtctcatttctgtagtattactgactaaactgcagaaacctgagtctacccatgaggaaacatcagtctcaaattgactgatattttgcttttagtattcaaacatactaatttcactgaggaaatggtccagattatttcagactatatagacatgagaatggaatatcacattggttcaggatgtctataaaaggataaggaaggttggcaaaatttgaagacagtccctcaagtagattatagtgttacgtgagtattaattgcctaagttatataattgcctgaggttatataacagaaaattcttgtttttaagaaattaaaacaatttaaaggataaagggataatgtcatagctgtaattttccaagcatttggataaaataatatacatgtttcaaaaaaaaaatgaaacagatgttgtaagatgttagcaaatagggaatccaggtggaaataatccaggaattatggatagtcttgtatctgttcagcaggtctgaaagtagttgatgaaaataatgcaaaagaacatgtcaaaaagaaatggtttgggcatatggcttcaagcatacataaatgctcaggaaacatgaaaatgtgaaataaatggatgagtactataataccagcaggccttgtagatacctgcatttgaagcatttatattagaaggaagcctttttacccagaatttttttcacttagcctaatgttttcaaggtttggccatgttgcagcatatatcagatctccattttttttgatggaggagtgatattctattgtataaatatatcacattttgctcatccactcactagtttttggctattatgactaatcccgccaggaatatttatgtggaggtttttgtgtgtttatgttttcaattctattatacatgagaatatagtaactgtgtttatttgacattttgaggacctgtctgtaagtgatgtttaagataatttttgttacatttgaaggcagataatagtctatgcaaaatgaatattctgttgaatattgatgtgaactattcttattgtaaaaaaaaagttacattgaaatagtaagtatagaagttatatcttggtggcggggcgtggtggctcatgcctgtaatcccagcactttgggaggccgaggcaggtggatcacagggtcaggagatcgagaccatcctggctaacatgatgaaaccccatctttactaaaaatacaaaaaattagctgtgcgtggtgatgagcgcctgtagtcccagctactcaggaggctgaggcaggagaatcacttgaacccaggaggcggagcttgcagtgagctgagattgtgccactgtactccagcctgggtgacagagcgagactctgtttcacccaaaaaaaaaaaaaaaaaaaaaaaaaagtattggtttttgtactcaacaagcagttttatgtttttatttttcaggaactctccaatactgaattcaggctgggatattagagaaaaggaaaatacatgaaactcagtggtgttttatggcactttgagttccccaattcaccttcaaacatttagccttccaagttctctgccaccgtatcagtgcatccctcctgagattcttaattctttgattgtgtaaagatggactatgcttactccatcttacttctcttaggtcttacaatggaagtgccctattacattttgttcttttctatgatttccaattattttatgaaatttttcatttattttttctgttctttctatctttaatttctatgtaactttttgaaatagatctcaaagattttatatatatatatatatatatatatacacacacacacagagagagagatatatatctactgtactattgaagtagattcctaaagtttttatctcttctagaatattggtttcacaacacccctattatgtgtatttaattttacccaccacatggcgttttcaaaaagtctttatttggcggaatacaacttcagaatctgattcgaagagaaaattgctcacagccgtgagccactgtgcctggccgatttttactatttaaagaaggaagaattttagcagcgtggggtggctcatgcctgtaatcccagcactttgggaggctgaggtgggcggatcacttgaggccagtagttcaagaacagcctggccaacatgacgaaaccccatctctactaaaaatacaaaaattagccaggcgtggtggcacgtgcctgtagtcccagctactcgaaggcttaggcaggagaatcgcttgaatcagagacagggaggctgcaatgagccgagattgcaccactgcactccagcctgggcgacagtgcaagactccatctcaaaaataaagaggaattggaggaggaaataaatgaataaatgacaaaggtgacaaaggaccaaagatctgtgacttgtgcaaagattgctctgtggtaattattacagaaacaatgtttgtatcttattttttagggaattttgtatattgtctaatctgatttactttgtttttaatagtttgctgcaggtctagaagatgtcacagaatttcaaggaagagaggtgagcagctgctgtggtgattttgaaattgtttgtgtgtgttgtggccagtgatgtcagaatttcaggatctgagagttcatgattttagaggctcaaaggagaatatttttataacttttttctataatttttttataatttttttatatattttttataatattttataattttttttgctatgtgagtatccctactttgttcaaggaatctcattatcttttccctttttttaaaaagggatttttttgtagtaacctgaataaattgggggaagtattgatatatttccttttctcaccattttttgttggatgaaaataatcttttagtgaaattcagtgtattaaatatttattttttaaagtctagagatggggtcatgctgtgtttcccaggctgcccttgaactcctgggctcaagcaatcatcttgcctcaacctcctgagtagctgggactacaggcatgtgctgccatgcctggcttaaatatttaaaaaattttatctggcacattctgaacacagatgtttctacttatatttgtcatgtagtcacagtatatattgattttgctacctcgcctactcctaaaagttttaattcatttaattggtcttaattggacttaaaaattttttccctggccgggcgccttggctcacgcctgtaatcccagcactttgggaagccgaggcaggcgtttgagaccagcctgaccaacatggagaaaccctgtctctactaataatacaaaattagctgggtggggtggcacatgcctgtaatcccagctactcaggaggctgaggcaggagaatcacttgaacccgggaggcagaggttgcagtgagctgaaattgtgccattgcactccagcctggacaacaagagcaaaactctgtctcaaaaaaaaaaaaattcccaatagattttaatctaattttattagaacaattcagtcatatgttttttcatgctatgtatatgagagttccattattcagatactaaacaaatgtctactgtacatttactcttctcactgatgatggattagataaccatgcacaaaataagcctggctgtggaaatgcttatttgttgggagggtgcttgtttggatcgatgatgagaataattgtctgaggatgctgagggactcattccagatgtcaatctgaggtccagatgtgtggccctccaataggacaaataagactctcagagcctggctctatttggggatccctcagtgacaacatagtacctctgtgagcgtgccttttctatctctccgaagagggcattagcatcctgtcttatgagtcagtatgcactttagtatggttagtgacccaagactcactttattttgttcattttgagcagagaattgtagatagatacatatatgggaaatatgttcttgattaacaaatgaaaaaatgaaaaagtttcagtcaagaaaggtcaaggaactgtgatgtatagtgaaggcagggaacactgcatgcctgtattaaatattgacaaaggaaccaattttagtgctttgttatttttactgttgagtattttctgagaccatttctttttcttctattttgttttgctgaggtagaggagggctggaatgaggtcctccacttcagaaaataggggtgagtagttaaaccaacatcctttggaattcatatacgtcatgcgttccatgccacatcctgagatctttttgttgatttttttagtggcttactggataatatctaaatactgtatattttactttggtgagtctctccaccttcatttctgaatcattgtcctttacatttttattctatttgaattttgcatgaaatgacaaatgtagaattttgcccaatttattttatttattcatttatttatttgggaagacaaagtctctctctgtcacccaggctggagtacattggcccagtcagagctcacttcagctcttcaccctgtagcccttaactcctgggctcaagtgatcctccaccctcagcctcccaagtatctaggaatacaggtatgtgttaccacacatagctaatttttaaattttttattttgtgaagataggatcttactgtgttgctaaggctggtcttgaactactgggctcaagcagtcctcttgttttggcttcccaaagtgctaggattacaggcaggagccaccatgcctggcatcattagggatattggtctgtgattcacttttgatgatgtctttggttttgataaaaattagggtaatagtagactcatggaataagttgggaaatgttttctgctctcctgttttttggaagagttgtgaaggattgatgttatttctttaatgatttggtagaattcatcagagaaatcatttgtgtggaattttatttgtggaaacttgagtagctaattcaatctcttgttaaaggtgacttcaattttctgtttttccttcttgtgacagttcctgtaatttatatatttctaggaatgtgcctatttaatctaggttatgtaatttgttgacataacttgtttatataagggtgttagtctgattttcatcccagattttatgaaaattgggtcttctgttttcagtagtgtagatatagttatgtcaattttttaagagacagagtcttactgtgttgtttatgctggccttgaacttctgagcctaagcaatcctgctacctctgcatcttgagtaggtgggagtgtgggaacacaccaccacacctggcctgtcactaaacaaacaaaaaatttcagtgaaccagcttttgatatttttatttttcttctgtattttttattttatttattggcattttattcttatatcttttattctacttgatttagctttgctttgtttttctgttttcttaaggtaaaagtttagattattgatttgagattttcctttttttaatatggacatttacagctataaatttcccaaagaactcttttagctacatatatattttcttttgttgtgttttgtttcctttgatttcaaactattttataaattttcttatttctcccaagaactcccaatgattcttagtaatgtgttaatttccatatattgtgaattccccccaatttttttcctttatttctgatatgattctattgtggttggacaccatacttttctgatttctttactttcagatttgttgataccagtgtgtggtctaatacctaccctgcacactgttccatgtgcacttgaaaataatatattttctactggttagattgttccatagatggatgttatgtaactgttttatagtgttgtttgtcttctatttccttgatcttctgtctcattgttatgttcatcattgaaagtgaggtattgaaattttcagttattataatgtttattttgccttccattctgtcatttttaaaatttaatttgggggttatgttgttggatgcacgtatctttattattgttatatcttcctgatggattgacagtttaatcatcatgaaatgtcctttgtctctaccaacaatttttttttttttgagatggagtctcgctctgttgcccaggctggagtgcagtggcaccatctctgctcaccacaagctccgcctcctgggttcacaccattctcctgcctcagcctcccgagtagctgggattacaggcacctgtcaccacgcctggctaattttttgtatttttagtagagacggggtttcaccatgttagccaggatggtctcgatctcctgacctcgtgatccacccacctcggcctcccaaagtgctgggattacaggcgtgagccaccgtgcctggccctctaccaacaatttttatcttgaaatttatttagcctgataattgtagtttttgtctgacttatagcccataaactctctctggttactgtatgcagtttatcttgtcattattttactatctacctatttttaattaaaacaaaatatctttgagacaggatctcactctctcacccatgctgtagcgcaatggcatgatcatagctcactgcaacctgaaactcttgtaattcaagcaattcttccacctcagcctcctgagtatctgaaactacaggccaacaccaccacacctggctaatttttttgtattttttttcttgtagagatgaaatcttggtatcttgcccaggatggttattttctacctattttttgtccttgaatctaaagtgtatcttttgtagagagcatatagttgtatcatgtgtttttttaaaaagatacatctctgccttttaagtggagagtttacttcatgaacatttaatgtaattactgataaggtaaaattcacatctgccattttctattttcttttatggcatatatctgttttgtttttcttattgttctttatgttaaataagtaatagtgtactgctttaattttctttttaattttttgtgtttacttattagtggttgcctttgagattatagttaatttgttaatttataatatagcttagatttaatagttaattttaatagtacacagaaactatttttcaatatagctctgttttctcacccttccttttgtatattattgtcattcaaacatttataccatcttttatatttgcctaataattattttactggtcctgtgcatttcttcatatggatcaaagttaatgtctagtgctatttcacttaaggctgaagtctccatttaatttttctggtaggataggtattttgacaaattcagcttttgttggtttagaatgtcatttcttttttatttttgaagagtacttttgctgtttcaagatctatgggtagacagtcttacttctttttctttaaaatagtttgaatatgttatcttactgttttatggcttcaagagtttctgatgagaaatcagctgttagtctcattgaggattccttgtacctgatgggtttgtttttctcttcatattttgaagactggcttttgaaatttttactatgacgtctccatgtctttatgtgtatctcacttgagtgagtcaagttcatttgactcattttatatgtacatgtatgtttttcccttacattaaggaaattttaggcgtttgttcttcaaactgtttctgcccttctactgtgacttttatgaacatgttgatatgctgtgttcctcagttctctgaagctgtttttcttttttctttctgcttcacagaatggatctcctcaactgtcctgtattcaaattcgattaccttttcctgctagctcaaatagtgtgattaaatttttctagtgaatttttattatttatttctctgtatctttattgtctagtaattgatacatttttaaaaaatttaaattttaggtttaggagtacatgtgcaagtttgttatataggtagattgtgagtcatgttggtttggtgtacagattatttcattacccaggtaataagcatagtacctgataggtagttttttgatcctcactctcctcccaccttctaccttcaagtgctcccagttacaagagagaatgtatggcatttagtttactgttcctgcatcaatgtgcttaggattatggcctccagctctattcatgttgctgtaaagaacatgatttcattcttttttcatggctacatagtattccaaggtgaaaatgctccatattttctatgtccagtctaccagtgtgatagttaatattgagtgtcaacttgattggattgaaggatgcacagtattgttcctggatgtgtctctgtgaaggtgttgccaaaggagattaaaatttgagtcagtgaattgggagagacagattcaccctcaatctgggtgggcacaatctaatcagctgcacagtctcatcagctgctggtagaataaagcaagcagaagaatatagaaggactagactgtctgagtcttccagccttcatctttcacccatgctagatgcttcctgcccttgaacattggacttcaagctcttgtactcttggacttacaccagttgtttgcaaggggctctcaggccttcagcccacactgttggcttcccgacttttgaggttttgggactcagactagcttccttgctcctcagcttgcagaggaactattatgggacttcaccttgtgattgtgtgagtccatcctccttaataaactcccttttatatatacatctatcctattagtcctgtccttctgggaaaccctgactaatacaaccagtcctgggtacctgggttgattgtatgtctttgctcttgtgaataccacagtgatgaacattgaagtgcatgtgtcttttggtagaatgatttattttcttttgggtatataccagaaatgggattgttgggtgaaactgtagctctgttttaagttatttgagaaattctcagactgttttcctcagtgaccggactaatttacattcccaccaacagtgtttaaacattcccctttttcttcaggcttgccaggatctttctcttttttgcttttaataatagccattctgacgttgtgagatactatcttattgtggggttttttttgttgtcgtcgttgtttgtttttcgagacagagtcgcccagggtggagtgcagtggtgtgatctctgctcactgcagcctatgcctcccgggttcaagcgattctcctgccttagagtcccaagtagctgggactgcaggcgtgtgccaccatgcctggctactttttgtatttttagtacagatggggtttcaccatgttggccaggctggtctcgaactcgtgaccttgagtgatccaccaccatggcctcccactgctgggattacaggcatgagccaccgcatcgggcccttatggtggttttgatttgaatttctctgatgattagtgatactaagagcattttttcatatgtttgttgaccattctatatcttcttttgaaaagtgcctcttaatggggttgatttttgcttgttgatttatttaagtgccctatagattcaggatattaggcttctgtcaaatgcatagtttgtcaatgatctctgttcgccaatgatatggttctatacctagaaaatgccttctttaagaaaataaaattgtattttgtggatgtatcacattttccttatatatctgctttgggcatttgggttgcttctgcctcttgggcattatgaataatgctacagtgaatatggatatgcagatgtatgtttgagatcttgctttgaattactttggatatatacccaaaagtgggattcctggatcatatggtaattctattgttaatttttcaggaacctccatacatttttccacaatggctgtaccattttatgttcccatcaacagcatgcaaaggttccagtttctccacattgtcaccaacacttgctgttttttatttcactcttgttgcccaggctggagtgcaatggcactgtcttggttcactgcaacctccacctcctgagttcaagcgattctcctgcctcagtctccccgagtagctgggattacaggtgcctgccaccatgcccagctaatttttatatttttagtagagacagggtttcaccatgttggccaggctggtcttgaactcctgacctcaggtgatccacctgccttggcctcccaaagtgctgggattataggcctgagccaccacgcctggctcgttgtttttcaattgtatcttctaatggatgtgaggtgatacctcattatggttttgatttgcatttgtttagtaattagtgatactgagcatgttttcatatacctgttgtccatttgtttatcttctttggaaaaaaatctattcaattactttgccccttttttaaaattagggttttttgttgtaatctgagtttgttccctccctccctcactctctccctccctctcttccctccttccctccctccttccttccttccttccttccttccttccttccttccttccttccttccttccttcctttcttccttccttccctccctccctgtctccctccctgtctccctccatgtctccctccctgtctccctccctccctcccttcttttctcccttcctccctcccttcctccctccctttctcccttcctcccttccttgatcacatccacatccttccttccttcgtgctgtgttgctcagcatggagagcagtgccaaaatcatggctcactgcagcctcaactttccaggtgccagagagcctcccacctcgtgctcgtgggaccacaggcacatgccaacacgtctagctaattgttttttaatttttattttttggtagatatgggggtctcactgtgttgcacaggctggtttcaaactcataggctcaaggaatcttcaaaccatggcctctcaaagtgttgacattacaggcatgagttaccatgcccatcctgcatgtgaaagccttacgagatatgatatgcaaatatttctctcatttggtacgtttcctctttcattctgttgattgtttcccttcatgtacaaacattttaggtttgatgtagtcttgcttgtctgtttttgcttttgttggttatacttttagtgtcacattcaaaaacttattgacaaaaacaagaagggtttccatgtgttttcttctagttttacaatgtcaagatgtatctttaagtacttaatttattttgagttgatttttgtgtatgttgtaaggtaaggattcagtttactttttttttttaatttgcggatatccagtatgccaaatatgattagttagataaactgtgctctgagcacccatgtcaaagataaattgagtagagtacatggatttatttctgcattcttcattcttttccattagattatgtctgttttttgccagtattctagtattttgaattactatagctttgttatatacttggaaatcaagaagtgcctccacctttgtgtttcatgctgaatattgatttagctattttggttcttttgtggatccagataaattgtatgatttttttctctatttctggaaaaatgtgattgtgattttgataggaattatagtgaatcagtagataactttgggtagtatggatattttgacaatattaattagtcccagtggtggtgttgaggccgtgttgacctggaggcactggggtcagtgatagtgttgtcaagttggctgcaggatgggatggtgcctgggaggtcagtgcataaaaatcctatggatgtgatcaaggaaagggtgatggaaggtgatgtgtcctgtctgcttggtccttgtaggatcaggcaggacatcctgtaataaaaggagacattaccttcggatgtcctgagggcatggtgcaggcaccaggactgagtggaggggaggaagctcatgtcttgaggtcctttggctacatggggaagactgtctctgggcttgatgctgagttccagactgacgtgctggctgttgtgatggtgctctccagtgctggttgtggttggtttttggctaggtacacctcacctgggacagtggccaaagacagtgtcagttccagacatcagaagccccatgaggaagagcatgtgctcgcgccaggagtggtggctgttaggggagggacctcagacctatgtctgcatggcctgaggtcagagttcacatcctactgattgaagaccttgttcttgagctgtccggttgccacagggtcggacctggaggctgcagaccatcgtggccctttgcagtgttcggaaacatatgcgcaccccagggagggacacacacacacacacacacacacacacacacacacacacacacgcaaactcacaaacacaacacacagacagaaaatgacaaataaacacacacactcacacacacacacacaggagcccacagaaaaaagcaaatagacgcagaaacgggcacgtgcagtagttctggccacacatgttccctaggtatccacagaatggcatgggtattgtatattcataaagatggagatcagtcatggaggccaaggacaagtaggtgcactggttgaactacagtagagaatggcatggaagtggtgagcaatggacctgggcctgtttctcaagtgtgtatttgatttctttacaattccccggagaagttgtcatgggaggccagccgcctgctggcaaggaagatggttgattcttctgatcaatggaggccctgcagagtcctgtagtcactgtggcctggcatccatggtgcacccaatgctggtggatggcttaggacggtaagcattcctctgccccacgtgctgaatgagagtggcttttggatgtcctataccttcaaggagctgtttgtcagcagcgaatgacatggcaagttccactcctagagtggatggtctgtgcccattgctcagtggtgcagctctggcttccccagcatgctgaatgtctttaaggtcatcagctcgccccttcccagcctgtggtgtcaaatgtcttgccccttgtcaaatgtgcttggatcgatgatgagtcccctataaaaacattccttggaaaagctgaacaaaatgagtgagaactcataacgtcattctcatcggaactgaggtccagcatgttgcttcctctggggcctgtaggagtgagggacaacttccactgattcccataggttccaccacccagggcatccacagacaaaagtctcgtgtcacaggcacgttaggaacattccctctgtgtgaggtacatgggtgggagagtgatgggggattcggccgctctgtgatggcgtggtggccgtggaagcaggcagaaatgttgcaggcctaggggaagtggaaatgttgccagcacaggggtgtgtgctactggtaagctcccagaaggaagacccggacctcacagtggtcatctcagtgcagaagaccaggtgtctgttttcatgtcgaggagagcccaaggcccagacctcaggcagaccttggtgttgatttttgattagttgagaacaggggagtgccaaggtgttaggggagagtgcagagcaataggtgtcggggcaaacagtgaaagcctcttcagcctaccctgcagcattggtcaccaggagccctcctggaagggatttctttgcctcctgagctgtgagatgcctgtggtgcagtggcagaggcctaggtaggaaggtactccaggggaaaggtggtagagggatcacatggacatgagtgtcattagcaggcttgggctgtcattcaggggtgatgggcttcccatggatttttctggtggaagacaggttggccagcaggggtcttcgaggccaggtcctggggagcacgaggatcgagttggtgcccgtggccctgggtcacttccagtcttcccaggagagtaatgggctcctccattgtgcaaatcttcctataaatggtctcttggcccgccattattgggcggctccacctgctgcagcttgtatgagcaaatactgctctggatcctctttcctgcttggaaagcagcttcagtcctgaaggtccagagtgaatgtgccctgaccctggctctggcccaagtctgtgccgtaggtactcgtcacacttggagctatccatggaggtctgtgtgcattccaggcaacacgggtgcaatcccaggggtgctgccacagagtccttttacttgggatgcctcacacctctgcatgttggcaatatttaagtgttggagtccactacaccctaggggtgatgaactgttttggctcccttaaccggtttgaagtctcagcgcagccaggacagccatgccatgttgaagggcatgcagatggcttaggaatgttggaaaggatgggtggttctgagctcgcagctcactcactagctgcatgcatgtagacccagtggtggtgttcaggtagtgttgactttgaggcattgcggcgggtagtagtgcagtcaagttggctgcataatgggatgttgcctcagaggtcagtacaggatagccctgtgggtgtgtccaatgcaaggaaaatgaaaggcagtgtatcccatccgcctggtccttgggacatcggtaggggggacgtcccattggaaaagcagccattccgtttgtgtgtcgagagggcatagtgcaggcacatggactgagtggaggggaggaaggctgtgtcttgaggtcctttggctagattgggaagaccacctctggccttgacgccaagtttcaggctgatgtgctggccattgcaaaggcgccctccagcacaggttgtgattggttttccaccaggtacgcctcacctgagagggcggctagagacagtgtctgctcaggacatcagatgtcccgtgaggaggagtgtgtactcacaccaggggagttgactggtaggcgagccaccttgggcctatgtccgcatggtctccaggtcaaaattcacatcctactgattgaaggccttggtcttcagctgttgggttggcgtggtgtcaggccaggaggctgcagactatgactgcctgttgcagtgttgggaaacacacatgttaggaaacacatgtgcatgagggagacacacacacacacattcatacacacacacacacacacacagaggcatgccgagccacaggcaaatacatgcagcaatgggcgtatgtgaccacgtgcacttttaggtatccacagagtaacacatgtaagatatattcatggagatggaggtcagtcgtggaagccaaggaataacgggtgtgcaagttgcccaacgggaaagaatgggattgaagtgttgaccagtggacctgagcccatttctcaagcgtttatttgatttctttacacttctcagaggcagttgctgtgggaggtgtggtaactgctggaaggaagatgctcaattcttctgagcaacgaaggccacacggagtcctggattctgtgtggcctggcatccatggcgcactgtgtgctggcaggtggctcaggacggtaagcatttctctgcccagtatgctgaatgagggtgtctttcggatttccaagacccgcaaggagcagtttctcagctaaccactaatggcatggcgagttcctctcctagagtggatagtctgtgctcattgctcagtggcatcgctctagtggggccgaaggtctttaaggtcattggctcacccactgcccagcctgtggtgtcaaatatcctgccccttgccccttcaaatgtgcttggatcgatgatgagtccccaaaaaaaacattccttggaaaagctgaacaaaatgagtgaaaactcataccgtcattctcatcggaactgaggtccagcacgttgccttccccggggactgtaggagtgagggacaacttccactgattcccataggttccaccacccaaggcatccacagccaaagtctcccatcaaatgctcattaggaacattccctttttgtgaggtacacaggtaggagagtcctggggggaacggctgctctgtgatggcctggtggccatggaagcagacagaaatatcgcaggcctagggtagtgtgcgcctgatcttggcttggtgagctcctaggaagggagacgcggacctcgtggcaggcgtctctgagcagaggactgagtccttgttttcttgccggggagagcacaaggcccaggcctcaggcagatgttggtcctgatttttgattagctgaggacaagggagtgccaagggtgatgggggacagtgtataacaaagggtgttgtgacagagagccaaagcctctttggccctccacccagcatccagtcatggaggccccccagcagggatttcttcatcccctgagccgtgagatgcccctggtgctatggtggaagcctggactggaaggtactccacagaagaggtggtagggggcttatgtggacatgtgtgtcatcagcagtcttgggctgttgttcagcgttgatgggctttccatttatttctctagtggatgacaagttggccagcagaggtgtcagagggcaggttccagggaatacaagggtcagacttgtgctcctggcccttggtcacttctcgtcttcctgacagagtagtgggctccactgttgggcacatcttcctggaagtcgtctcttggcccgccattgccgagcggccacacctgctgcagctcgtgtgagcaaatatggctctggatcctctttcctgctttgaaagcagcttccatcctgaaggcgtccagagggtatgtgtcctggccctggccaggaactctgctgtgggcattggtcacacgtggctatccatggagatccgggtgcattccaggcaacattctaggggcctgccatggagagttcgttgacttgggatgcccctgcacctcccatgttggtgatgttccagtgttgcattctgctacaccctaagggtgatgaagcatttcagctcccttaaacagtttgatgtcacagtgcagccaggacagccatatcatgttgaggggcccacgactgcattaggaatgttggaagggattggtggttctgcagatcgcagctcattagtagctgtttacttgtagacctggtgatggtgctgaggcagtgttgacttgcaggagttgggatgggtggtaatgcagtcaagttggctgcatgatgggatgttgcctcagagttctgtgcagagaagccctgtgggtgtaaccagtgcaaggaccatggaaggcagtgtgtcctgtcaacctggtccttggggaagggacgtcctgttggaaaacagccattcccttcggttgtcctgaaggtgcagtgcgggcatgtggactgagtggaggaagcccgtgtcttgagatcctttggctaggttgggaagattgcctctggcttgatgccattttcagacctatgggttggtaattgtgaaggcgccctcacgtgctggttgtggttggttttccgccaagtgagcctcacctgggagtgcagccagagacagtgtcaggtcacaacatcagatgccccatgaggaggagcatgtgctcactccaggggtggtggctgttaggtgagggacctcaggcctatgtcctcctggcctgattttacatcctactgattgaagaccttggtcttgagccttcgggttgcaggggcttcaggtctggaggctgcagactatggcctcctgttgcggtgttgggaaacacatgtgcatgagggaaacacacatacactatcacacacacaaacaggcgctcacagccacaggcaaatatacgtagcaccacgtgcgtgtggtcgttccggccacacgtgcttcctaggtgtctagaaagtgacacagtcagatacatttataaagatggaggtccataatggaggccaaggagaagcgggcatgtgtgttgctctgtggaagagagtggcgttgaagtgaccagtgaacctgggcccatttctcaagcatgcatttgatttctttacacttctcaggggcagttatcatgggacacccgccatatgctggcaaggaagatggtcagttcttctgagccacaaaggcccccaacatcctggagttggtgttgcctagcatccacggtgcgccccctgctggtggatggctcaggatggtaagcattcctccgccgcacatgctgagtgggggtgggatttccaagacctgcaaggagctgtttctcagcaggccactgatggcatggcgagttccactcctaaagtgaacggtctgtgcccattgttcagtggtgcagctctggcttccccagcgtgcggagggtttttaaggtcatcggcttgcccactgcccagcctgtggtgtcaaatatcctgccccttcaaatgtgcttggatcgatgatgagtcccccataaaaacattccttggaaaagctgaacaaaatgagtgagaactcataccgtcgttctcatcggaactgaggtccagcacattgcctcccccggggactgtaggagcgagggacaacttccactggttcccagaggttctaccactcagggcgtccatggatgaaagtctcacatcacaggcacaatagaaatattccctctgtgtgaggtatacaagtaggagagtcatggggggattggctgctctgtgatgtcgtggcaactgtagaagtgggtggaaatgcagacctaggggagtgtgcggctggccttggcttggtgagctgccaggaagggagaccctgacctcctgatgggcctctctatgtggcggaccaggtcttttttttatgccaaggagagcacaaggcccagacctcagacagaccttggtcttgattttcagttatctgaggagaggggagtgccaaagtgatgggggacagtggagagcaatgggtgttgtggcagacagccaaagcctctttggccctccccccagtgttggttacaggggcccctggcagcaatttctttggctcctgagccatgagttatccatggtgtggtggctcagcctgggcaggacagtaccccagagaaaaggtggtagagggctcacatggacacgcgtgtcatcagtggtcttgggctgtcatttggcagtgatgggctttccatggatttctattgtggatgacaggttagccagtggggccttcaagggcagatccaaggagcatgagtgttgggctgtagcccgtggccctcggtcacttctggtcttcccggcagaatagtgggctccaccgttgtgcacatcttcctggaaatggtctcttggccctccattgctgagcagccccacatgctgcagctcttgtgagcaaataactgctttggatcttccgtcctgctttgaaagtggcttccatcctgaagactttcagagggaatgtgccctggccctggccctggctcggaactctcctgtgggattcggtcacacttggagctgtccatgggggtctgtgtgcagtccagacaatgcatatttaatcctaggtgccttccatagagagtcccttgatttgagttgcctctactcctctgcatgttggtgatactcaagtgttggatttagctacgccctaggtgtgatgaactgtttcaaccccgttagtctcagcgtagccaggatagtcatgccatgttgaagggcatgcagatggcttaggaaagttggaaaggattggtcattctgcggctcgtggctcacttagtagccatgtgcatgtagacctggtggtggttgtcagatgtcgttgagcaggtgttggggaggatggtcctgcatccaagttggctgcgtggtgggatgttgcgtcggaggtcggtgcaaggaaggcctttgagtgtgatcgatgcaaggatgatggaaggcactgtgtcctgtctgcctggtgtttggggcgttaggcagggatgtcccatgggaaaagcagccattccctttgggtgtcctgaggacatggtgcaggtacatggactgagtggaggagaggaagcccgtgtcttgaggtcatttgcctaggttgggcagactgcctgtggccttgatgctgagtttcagagtgacgtgctggccgttgcaaaggcgccctccagtgctggttgtgtttggttttgtgccaggtgtgcctttcctgggagtgctgccagagacagtgtctggtcacgacatcagatgccccgtgaggaggagcttatgctcaggctagggatggtggctgttatgtgagggcccttgggcctatgtctgcatggcctcgaggtcagagtttacatcctgctgattgaaggccttggtcttgaattgttgggttggtaggggctcaggtctggaggccgcagactatgactgcatgttgccatgttgggaaactcgtgttgggaaacacatgtgcatgagggagatacacacacacacacacacacacacacacagccactcagcaatgtgtgtgtgcgcggtcggtctggcgccacacacagctccaagctgtttgcagagtgccactggtaaggtacattcatggaaacagaggtcactcatggaggccaacagaagcaaggcgtgcaagttgccacgcatgaaagaatggcactgaagtagtgaccagtggacctgggcctgtttctcaagcgtacatttgatttctttatacttctcaggggcagttgccgtgggaggcccgctgcctgctggaaggaagatggtcagttcttctgaaccacaaaggccctgcagagtcctggagtctgtgtggcctggcttccagggttcacctcatgctggtggattgctcaggatggtaagcattcctctgccccatgtgctgagtgacggtgtcttttggatttccaagacccataatgagctgtttctcatgaggccactaatggcatggtgagttgcattccttgagcaaatggtctctgccttttgctcagtgccatggttctatcttccccagggtgccgaaggtctttaaggtcgtcagctcacctactgcccagcctgtggtgtcaaatgtcctgcctcttcaaatgtgtttggatcgatgatgagtccccccaaaaaaacattccttggaaaagctgaacaaaatgagtgaaaactcataccgtcgttctcagcggaactgaggtccagcgcgttgcctccagcagggactgttggagtgagggagagcttccactagtccctataggttccaccacccagggcatccgcaggtaaatgtctgccatcacacgcacattaggaacattccctttgcgtgagatacactgttaggagagtcacggagggattggatgctgtgtgatggcgtggcagctgtggaagtggacggaaaaatctcaggcctagaggagtgcgtggcactgatgagctcccaggaagggagacccggaccttgtgtcaagcttcctcgcacacaggaccgggtcctggttcccctactacagagagtatgaggtcccagcctcaggcagaccttggtcttgattttcagttagctgaggacaggggagtgccaagggtgatggggaagagtgcagagcaatgggtgttgtagcagatggccaaagcctcttcggcccttcccccagcgttggtcccagggtcaccccagcatggatttctttgcctcctgaaccgtgagatgcccatggtgtggtggtggagacctgggtaggacatattctctggtattccagagaaaaggtggtagggggctcacatggacaggtgtgccatcagtggtcttgggctctcatttggtggtgctgggctttccgtgtattcctctgatggatgacaggtcgggcagcaggggtcttcaagggcagttcccaggcgtgtgagggttgggctgctgcctgtggccctgggtcactccgatcttcctggcagagtaatgggctccaccgttgtgtacatcttcctgtaaatagtctcttggcccgccattgccaggcggccccacctgctgcagcttgtgtgagcaaatactgctcttgatcctttttcttgctttgaaagcagcatccgtcccaaaggcatccagagggaatgtgccctggcccaggcccaggaccctcccgtgggttccaatcatgcatggggctgtctgtggaggtccgtgtccattccgggcaatgcgtgtgcaatcccaggggtgttgccacggaaagtctcttgacttgggatgcctccacgcctctgcatgttggcaatgttccagtgttggattccgctactccctatgcatgatgaagcattttagctcccttagccagtttaaattcacagtgcagccaggacagccgtgccactttcaagggcacttggttggcttaggaaagttggaaaggattggtggttctacagttctcagttcacttagtagctgcatgcatgtagacctggtggtgctgatgcagtgttgacttgccagtgttggggtgggtagtagtgcagtcagattggctgcatgaggggttattgcttctgaggtcggtgcagggatgccctgtgggtgtgtccaattgaagaacgatgacaggcagtgtgtcctgtcaacctggtccttgggaattcaggtagggacgtcctgttggaaaagcagccattctctttgggtgtcctgagggaacggtgcgggcacatggactgagtggaggggaggaggcatgtatcttgaggtccttttgctaggttgctagtcctacctctggccttgatgccaagtttcagactgacatgctggactttgcaaaggcgccctctggagctggttgtggttggttttccgccaggtgcacctcacctaagagggtggccagagacagtgtcttgtcatgacatcagaagccccatgaggaagaggaggagcctgtgctcctgccagaggtggtggctgttaggtaagagacctgtgacctgtttccacatggcccggaggtcaaagttcacatccagtgatcgaaggccagggtcttgagccatcggattgctggggggatcaggtctggaggctgcaaactagaactgcccattgtggtgttgggacccacatgtgcattagggagacaaacatgcccatttaaactaacattctcacacatgcacacacccacacccacccatacacacacactctcatacactcacactcaaactcacactctctctttcacacacacacacacacacacacaggcacagacagccataggctaatagatgcagcgatgtgcacatggtgtggttctggccacatatgcttttaggtgtccacagagtgacgcaggtaaggtatattcatggagctggaggtcagtcatggaggccaaggagaagcaggtgtgtgagttgccctgtgggaaagaatggtgttgaagtgtccagtgaacctgggcctgtttctcaagcatgcatttgatttctttacacttctcagggacagttgccgtgggaggtccgctgcctgctgtcaaggaagatggtcgatgcttctgagaaacaggccctgcgggttcctggatttggtgtggcctggcatccacggtgcaccccgtgctggcgggtggcccaggacggtaagcatttttctgccccgtgtgctgagtgatggtgcctttagaatttctgagacctgtgagcaacagtttcttggcaggccattaatggcatggcgagttccattcccaaagtggatggtctgtgccggttgttcagtggcgcggctctggcttccctagggtgccaaagttctttaacgtcatcggcttgcccactgtctggcctgtgggtgtcaaatgtcccacctcttcaaatgtgcttggatcgatgatgagtcccccataaaaacattccttggaaaagctgaacaaaatgagtgagaactcataccgtcgttctcatcagaactgaggtccagcacgttgcctcccgtggggactgtaggagcgagggacaacttccactggttcccataggttccaccaccgaggacatccacaggccaaagtctcccatgaaatactcgttaggaacattccctctgtgtgaggtacatgggtgggagatttgtgggggcactggctgctctgtgatggcgtggcggccatggaagaggggagaaatgtcgtgggcctaggggagtgtgtggctggtctcagcttggtgagctttcaggaagggaggcctggacctcatgggtggcatctccatgcagaggacaaggtctcacttttgctaccaaggagagcacaaggtccaggcctcaggcagaccttgttcttgatttctggttagctgaggacagggaagtgccaagggtgatgagggagagtgtggagcaatgggtgccacggcagatggccaatggctcttcagccctcctgccaatgttggtcacagtgtccccccagcacggatttctttgcctcccgaaatgtaagatgcctgtggtttggtggtgaaggtgtaggcagggtggtattccagagaaaaggtgctagagggctctcgtggacatgagtgtgcattgggctttaatttggcagtgataggctttccatggatttctctggtggatgacaggtcagccagggtgggtctttgagggcatgtctctgggtgagtgagtgtgaggatggtgtccatggccctgggtcacttctgttgttcccagcagagtagggggctctactgttgtgcacatcttcctggaaatggtctcttggccttcgttgtcgggtggccccacctgctgctgctctcgtgagcaaatactgctctgtatcattcccgctttccatcccaaaagtgtccagagcgaatgtgccctgtccctggcctgggactctcctttgggctccagtcatgcatgaggctacccgtggagatctatgtgcattctgagcagtgtgtttgcaatcccaggggcattgccacagagagtcttgacttggcatgtctccatgtgactgtgtgctggcgatgttccagtgttggactccaaaagtccctaggcgtgataaagcatttcagctcccttagctggtttgaagtcacagagcaggcaggacagccatgccactttcaagggcatacagttggcacagaaaaattggaaaggattggtggtcgtacatcttgcagctcacttagtagctgcatgcatgtagaccgggtggtgttgatgcagtgttgacttgctggcattggggtgggtggtagcatggtcaagctggctgagtgatgggatattgtctcagaggttggtgcagggaaactctgtgggtgtgtctaatgcaaggataatgacaatgtcctgtctgcctggtctttggggggtcaggtggagatgtccttttggaaaggcagccattctctttgagtgtccagagggcatggtgcaggcacatggattgagtggagggaaggaagcgtgtgtcttgaggtcctttggctaggttgggaagactacctgtggccctgatgctgtttcagagtgatgtgctggccattgcaaaggcgccctccagtgctggttgtggttggttttccatcaggtgcacctcacctggtaaaggggccagagacagtgtctggtcatgacatcagatgctctgtgaggaggagcatgtgctcgtgccaggggtgctggctgttaggcaagggaccttggacctctttcctcatggccttgaggtcaaagttcacatcctattgattgaaggctggggtcttgagtctttggtttagtggggttggttccggtctggaggctgcagactatgactgcccgctggggtgttgggaaacacatgtgcattagggggacacacatccacacagagacacactcatgcacacatgtgtgcacagccacagacaaatagatgcagcaatgggtgtgtgcaatcgttaggccacacacacttataggtgtccatggagtgacacaggtaaggtatgaatgggtctttgaaggcatgtttctgggcgagtgagtgtcgggatggtgtccatggccctgggtcacttctggtcctcccagcagagtagtggtatgaatatggagatggaggtcagtcatagggtccaaggagaagcaggggtacgagttgccccgtgggaaagaatgacattgacgtggtgaccagtggacgtgggcctatttctcaagcgtgcatttgatttctttacacttttcaggggcagttgccttgagaggcccaccgcctgctggcatgacagatggtcagttcttccgagcagtggaatctccatggagtcgtggagtcggtgtggcctcgcatccacagtgcaccctgtgctggtggatggctcaggacagtaagcattcctctgccccgcatgatgagtgagggtgtctttagaatttctgagtcccacaaggaagtttttcagctggccattaagggcattgtcgaggcctttaaggtcatcagctcgcacactgcccagcctgcagtgtcaaatgtcctgcctctttgaatgtggttggatcgatgatgagtcctccaaaaaaaacattccttggaaaagctgaacaaaatgagtgaaaactcataccgtcattctcatcggaactgaggtccagcacattgcttcctctggggcctttactagtgagggacaacttccactagtccctataggttctaacacccatggcgttcacaggtgaaggtctcctgtcatattacaaacattccccccactcccctcccaaaaaaaggaacatttcctctgtgtcaggtacacaggtcagagagtcatagggtgactggctgctctgtgatggcatagtggccgtggaagtggatggaaatgtcgcaggcttaggggagtgtggggctggcctcggcttggtgagctcccaggaagggggacctggaaatcgctgcgggcatccttgcatagaggaccaggtacgtgttccagttctgctttcaaggagagcatgaggcccaggcctcagacagtccttggtcttgatctttggttagctgaggacaggggagtgccaagggtgataggggagagcgcacagcaatggatgttgtggcagacagctaaagcctttctgtccctcctttcacggtcagtcccagggggcccccagcacagacttttttcacctctcgagctgtgagattcctgtggtgttgtggccaagcctgggcaggaaggtaccccagagaaaaggttgtagagggctcacgtggacatgcatgccatcagtggtcttgggctgtcatttggtggtgatgggctttccagggatttctctggtggatgacaggttggccattgggggtcttcaagggcaggtcctagggagcatgagggtcgggctgatgcctgtggtcctgggtcactccattcttcctggcagagtagtagaagtgtccatcttcctggaaatggtctcttggcccgccattgccaggcggccccacctgctgcagctcgtgtgagcaaatactgctctggatcccatttcccgctttgaaagcagcttccatcccaaaggcgtccagagggaatgtgccctggccctggccctggcctgggactctccgatggggtccagtcacacttggcgtattcatggaggtccttgtgcattccaggcaacacatgtgcaataccaggggcactgccgtggagagtctcttgatttgggatgcctcctcgcctttgtgtgttggcgatgttccagtattggattctgctacatcctcagggcaatgaagcgtttcagctcacttagccggtttgacatcatagtgcagccaggacagccgtgccacattggcatggcacatagttgacttaggacagtcggaaagggttggtggttctatgtctcgcagctcacttcatagctgtttgcatgtaaacctggtgatggtgttgagatggtgttgacttgctgacgttggggtggttggtagtgcagttaagttggctgcatgatgggatgttgcctcagatgtcggtgcagcgaagccctgtaggtgtgtccaatgcaaggaaaatgaaaggtggtgtgtcctgtccaccttgtctttaggggttcaggcaggaatgtcctgttggaaaactagccattccctttgtgtgtcctgaaggcatggtgcgggcatgtgaactgattggaggaaggaagtgtgtgtcttgaggtcctttggctgggttcagaagactgtctctggccttgatgccgtgtgccgtgtttaagaccaacgtggtggccattgcaaaggtgccttccagtgcaagttttggttggtttggtgtcaggtgtgccttacctgggagagcggcgagagacagtgtctggtcacgacattatatgccccgtaaggaggactgtgtgcttgcaccgccaggggtgctggctgttagtcgagggacatcaggccaatgtctgtctgacccctaggtcaaaattcgcatcctactgattgaaggccttgggtctcgagccttttggttgcaggtgtggggatggtttccaggtctggaggctgccaactatgacaacccgttgtgctgttgggaaacatctgtgtgggggagacacatacacatagacacactcactctgacatacacacctacacatgcacaggcgtgcacagccacaggcagatagatgcagcaatgggtgtgtgctattgttgtggtcacatgtgcttcctaggtgtccacagagtgacatgggtcaggtatattcatgaagatggaggtctgtcatggagcccaaggagaagccggtgtgcaagtttccctgtgggaaagaatgggattgaagtggtgaccagtggacttgggcccgtttctcaagcatgcatttgatttctttacacttctcagcagcagttgtcatgagaggtctgccgcttgctggcaaggaagatggtcaattcttctgaccaacagaggctgccttgagtcctgatttggtgtggcctggcatctatggtgcacccaatgctggtgagtggctcagggtggtaagcattcctctgccctgtgtgcagaggtgtcttttgaattttgagacctgcaaagagctgtttctcagcaggccactaatggcatggcgagttccactcccagagctgattgtctgtgttcattgctcagtggtgtggctctgggttccccccaggatgctgaaggtgtttaaggtcatcagctctcccactgcccagcctgtggtgtcaaatgttctgcctcttcgaacgtgcttggatcgatgatgagtcccccataaaaacattccttggaaaagctgaacaaaatgagtgagaactcataccgtcgttctcatcagaactgaggtccagcacgttgcctcctctggggactgtaggagcgagggacaacttccactggttcccatgggttccaccacccagggcatttacagatgaaaatctcctatcacatgcatgtgaggaacatttcctctgtatgacatagacggatgggacagttgtggagggattggccactctgtgatgttgtggcagccacggaagcaggtggaagtgttttgacctagggttgtgtatggctggtctcggcttggtgagctcccaggaagggagacccgggcctcgcagcaggtgtctttatgtagaggaccaggtcacagttcccctgccaaggagagcatgaggctcaggcctcagatagaccttggtcttcattttccactagctgataatgggagttccaaggtgatggaggagagcacagagcaatgggtgtcaccgcagatggctaaagcctctttggccctccttccagcatcagtcacaggtgccccctggcatggatttctttgcatccctagccatgagatgaccatggtgcagtgaccaaggcttggccaggatggtaccccagagaaaaggtggtgaagggctcatgtggacatgtgtgtcatcagctgcattgggctgtcacttggtggtgatgggcttcccatggatttctctggtggatgacaggtcagccagggcgggtctttgagggcatgtctctgggcaagtgagtgtcgggatggtgtctgtggccctgggtcacttccggtcttctcagcagagtagtgggctccaccgttgtgcacacctttctggaaatggtctcttggcatgcattgttgggtggccttacctgctgcaactcatgtgagcaaataactgctctggatcctctttcccgcttggaaagcaatttccattctgaaggcatccagagggaatgtgccctggccctggcctgggattctccagtgggttccagtcatgcatggggctatccacggaggtctgtgtgcattccaggcaatgcgtatgcagtcccagcggcattgccacagagagtctctcgacttgggatgactctgcgtgttgacagtgttccagtgttggattccgctatgccctaggcgtggtgaagcatttcagctcccttaactggtttgaagtctcagcacggccaggacaggcatgtcacgctgaagggcacacagttggcttaggaaagctgaaaaggttggtagttctacggcttgcagttcacttagcagaaacgtgcttgtggaccccgtggtgttgagacagtgttgacttataggcactgtggtatgtagtagtgaggtcaagttggctgtgtgataggatgttgcctcagaggtcggtgcagggaagccctgtagatgtgtccagtgcaagaatgatgacaggcggtgtgtcctgtcaaccttgtccttagggggtcaagtggagatgtcctcttggaatagcagccattagctaggatgtcctgagggcacggtgtgggcatgtggactgagtggaggggaggaagcccgtgtcttgagattgtttggctaggttgggaagactgcctctggccttgacactgagtttcaaactgaggtgctggactttgcgatggtgccctccagtgctggttgtagttggttttccaccacatgtgcctcacctgagagggcagccagagagagtgtctggtcacaacatcagatgccctgtgaggaggagtgtgtgctcatgccaggcttggtggctgttaggcaagggacctcgggcccatgtccgcatggcctcaaggtcaaagttcacatcctactgattgaaggcctgggtcttgagcttttgggttgtgaggaggttcaggtctagaggctgcagactatgaccaccccttgtggtgttgggaaacatatgtgcatgagggagacacacatacacacacacacagacacactctctctctcacacacacacacacacacacacacaggcgtgcatagccacaggcaaatagattcagcaatgggcacatgctgtcgtttcggtcacacacgcttcctaggtctccacagagtgacacgggtcaggtatattcatggtaatggaagtcaatcatggaggccaaggaaaagtaggtgtgtgagttgccctgtaagcaagaatggcgttgaagaggtgaccagtggaccttggtctgtttcttaagcatgcatgtgatttctttacacttctaaggggcagttgccgtgggaggcctgccgtctgctgaaaggaagatggttgatgcttctgagcaatgaaggccccatggagtcctggattcggtgtggccttgcatccgtggtgcaccccgtgctggtggatggctcaggacggtaagcattcctctgccccgcatgatgactgagggtgtctttaggatttctgagacccacaaggagcagttcttcagcaggccattaagggcatggctgtggtctttaaagtcattggctcacccactgcccagcctgtggtgtcaaatgtcctgcctcttcaaatgtgcttggatcgatgatgagtcctccaaaaaaacattccttggaaaagctgaacaaaatgagtgagaactcataccgtcgttctcatcggaactgaggtccagcacatttgcctctgccggggactgtaggattgagggacaacttccactagttcccataggttccacctcccagggcatccacaggccaaagtctcccatcacacacaggttaggaacatttcctctgtgcgatgtagacgggtaagagagtcatgggcaaattgtctgctttgttatggtgtggcagccatggaagagtacagaaattttgcaggcctcaaggagtgtgtggctggcctcagcttggtgagctcccaggaagggagacccagatctcgcggcagatgtcactgcacacaggactgggtccgatttttttgccaaggagagcatgaggtgtgggcctcaggcagatctttgtcttgatttctggttacctgaggacaagggagtgccaagttgatggggaagagcaatgggtgtcccagcagatatccaaaggctctttggctctccttccagggttggtcacagggcctccctggcagggatttcttggcctcctgagctgtgagctgctcgtagtgcaatggcagaggcctgggcaggaaagtattccagagaaaaggtggtagagggctcacgtggacatgtgtgtcatcagtggtctggggctgtcatttggcagtgatgggcttcacatggatttctctggcagatgacagctcagccagcaggggtcattgagggcaggtcacagtgaacatgagggtcaggctggcacccacagcccttggtcacttctggtcttcacggcagagtagtgggctccactgttgtgcacatcttcctggaaatggtctcttggcccgccgttgccggatggccccacctgctgcagctcgtttgagcaaatagtgctctggatccactttcccacttggaaagcagcttccatcccgaaggcatccagagggaatgtgccttggctctggctctgccctgggcctctcccatgggctctagtcacacttggggctattcatgaaggtctgtgtgtattccagattccaggcaacatatgtgcaatcccaatggcattgccacagagaatcttttgacttgggatgcctccgtgccactgtatgatggcgatattcaagtgctggattctgctccatcctggggtgatgaagcgtttcagttcccttagccagtttgaagtcacagtgcagccaggacagccatgccacattgacgggcttgtggttggcttaggaaagttggaaaggattggtggttctacagctagcagctcacttagtagccacatgtatctacacctggtgctggtgttgaggtggtgttgacttgcaggcattgttgtgggtgggaatgcggtcaagctgactgcacgatgggacattgcctctgaggtcagtgcagggaagccctgtgaggtgaccagtgcaaggacaatgttaggtggtgtgtcttgtccactcggcttttggggcatcaggcgtggacgtcctgttggagaagcagccattctcttcaggcatcctgagggcacgtgtgcgtacgtggactgagtggagtggaggaagctgtttcttgaggtcgtttggctaggttgggaagaccacctctggctttgacgtcatgtatcagtgcaacattctgagcattgggcaggtgccttccagcacaggttttggttggttttccgccagatgtgccttacctgggagtgcagcaagagacagtgtctggtcccgacatcagaggccctgtgaggagtagcctgtattcgcgccaggggtgtggtggctgttacacgagggacatcaggcctatttccacgtggccttgagatcagagtgcacatcctactgattgaaggtcttgaacctttgatttgttggggggatcaggtctggaggctgcagactataaccgcccattgcagtgggaatctcacacacacacacacacacacacacacacacacgtgtgcacagccacaggcaaatactcgcagcaatgggcacatgaggttgttccaggcacacacacttcctatgtgtccacagagtgacagaggtaagatacattcatggagatggagatcaatcatggaggccaaggagaagcaggcatgcaagttgccccacaggtaagaatgggtttgaagtgaccagtggacctgggcccatttctcaagcatgcatttggtttctttacacttctcaggggcagttgccatgggaggcgcaggcctgctggaaggaagatggtcgattctcccaagcaacaaaggccacgtagagtcctggtttcagtgtggcctggtatccacagtgcaccccgtgctggtgggtggctcaggacggtaagcattcctctgcccttcgtgctgagtgagggtgtctttgggattcccaagacccacaatgaacagtttttcagtaggccactaatggcatgctgagttcctctcctagagtggatggtctgtaccttttgctcagtggcacagctctgggttccccagggtgccgaacatgtttaaggtcatcggctcacccactgcccagcctatgatgtcaaacatcctgcgtctttgaatgtgcttggatcgatgatgagtcccccataaaaacattccttggaaaagctgaacaaaatgagtgagaactcataccgtcgttctcatcggaactgaggtccagcacattgcctccactttggcttattgtggttcacgggtaactgtcatattacatggtacttcactacccaggcactggcattcaatttttgtggtcgttttgaccatagtaaaattctttatcataaatgtatttgagaatcatacttgggtagcccatgaatttttttagtgttactcttcttggtgtcaagttggtttcacccttaatgctaggttttggatttttgttgcatgattgatttttagccaggttctggtcaccaatcacagcctttcaccaacattcatggagaaagtttccttgttttttttatatgttgaggaagtacatatttcctgaatgtttttgcttttgttccaatgttgggctgactggcatgtcatctcttatcttatcttgaactgagtagtggtacaagtttttggctttcagcatccagggcaccaagtcttttgtacacaaattgcaagtattgaagccatggtgttgattgggatgctctacgcccatactctttagtggcatgacgccctcccagggtacccggaatccacatgtgcaactctgtatatgtgtttctgtgaacacagatatgtgaagccatagataagcagatttcatatgtaccacaggagtctatatgacatagccttcctgacctatgtacctgtctgtctttctgaagcacactcatttcctctgcaccttcctggtgtcattggcatggaaggaaggcccttgtccaagaaggatggtcttcgtcttgtgtgatctttgagatgccatgaggcccctggatacaaatggtgtgggctcctttggaggcttttggatttctcctgaatgtaagtgatttcttctgaaagcattctgattttcctcacttgcagggacaaagactatgtgtaggttgatgatgacttacatatatacgttttttttttttttttggaaaggtgaacaaaatgagtgaaaactcagtaccatcatcctcatctaactgaggtccagcacgcttctccatcagggcctagatttagggggccaacatctgtttgttatcatggtgtgcaccaaggcttaggatgtagttgtctttcagtgaaactgagtagctgagtattttgtactcccctggctgagagatacgtttgttgaacgacttacctgtgagaaggtggggtagcatcctgccagtgtgcaggagaaggtaaacctgcaggtgccacaggaaggcggtatccagttgcccacctctgcatggctgggtctgtccttgattcatacctcttgggttcgtcaccccccagaagaagacaatttattccacatgaggagacagcacggtgccattcctgagcacttcttcaactgtctttcatctgtggccggggacatgggacttcttatggtgtttgggtagcatcaagggctggccatcttgaagccagtggtgatgctgatttgctctctggaaaggagcctggagaagctctctacagtgaacttgtacatctataagtagaattccaaatttcatggcccaagaagggtagtggctgtgggaaggggagaggtctgtgtgtgcctttacctggcatcattccatgtgggtcgtggagtgatgactgtgaggctctttaagacattgcagggtgcccaaggtccatttcgtgatatcctcaggatggtttgcttgggagagcctgatgtcatttgcctctgaaccgctcagacatcttgatgcagttggggtttataagagtgtgtcattccccacatcgtggtgacttctacttggaaatgtgacctgcgaaggtctccttgcttatatacctcagcgtctcctgatattagggtattttcaaattcctcctaattcttcacagcagtcttctttgtgaaatagtcgttgtgtggtaggacagggctaccatccacaggccaatgatggataggtgttggactctgatgttatgttcacaggcaagtgccttaagatcttgttttcttagctgcagcaccttagaaatcttgtaggattcagaatgcctggtgctcttctgggtccctgatctgtacctgtgtagtgcacatggaggttgatttgtgatgtttctggatgggaagagtgtgaaggacccaaggggtaaaaatgcctcaaggccaaaggaaagttaacctttgcataggaagaggtttcccctccaaactctcctcactgaagtatcaccatagcctttgtcttctctgatggccaggagaagggtttttgagttggaggtgttataagagtggtgttgagagtgttcttcatgcttagtgctctctagttgatggtgccttcaaaattcatgcctgcctcctaccttcatgtttgggcaaacccatgcatgtgtgcagaaagaaggggagcccatgggaggtagatacagattactccacaacaggacaaatgacatgacccttgccacctatgcacctcactgcctttctcaagcacactgttttgcttctgcacttcttaggtggcgttggtatggaaggaaggccagtgaccgcaagggatgactttgatcttgggagatttttggagatggcaaagtgcttctaaacatgtttggcatggtctccttcaggctggtggatacctcaggatggtaagtattggttttccaaaggcacctaatgttccatgtttgcaggtatgaggactgtgcatggatcaatgatgacttccatacgtgggttccttggaaagttgaacaaaatgagtgaaaactttatactgtcatcctcttcaaactgaggtccagcacactgcttcaacaggggctagagatggaggtctacctctcattcattgacgtgggttgcaccaaggggtctgtccaggcttaggatggggttctcttttggcaaggggtagccccaggggagtgggagctcccatgcacaggagattcctggtgtgaaggacatctcttagtgaggccagggtagcacacacaccatcttcaagactaggtgaatgtgcaggtgacacaaaggacttaggctctgtgtcccccagtttgttcttgagtcttagttcttggttctctcatcatcgggaggaaggcaggtccttctcgttgggaagagaggacaagcctacacttttgcctcatttttggctcatttttatccttgtgtatgtacatagatttctggtcacctgcatgcttcacatccaggccagagtgcctctgttgtaccctctgtgttatgaagacatacagttggcctcctgccctaagctggggctgataggcaacgagtctctggcttatctcaaacctggtgtaggtcaaaggcttcctcgttaggggtgcaggtccccgaggcttttatgatcaactttgcaggtgtgcacgggtgtttaaagggatgctcaacatcagttctctctagtgggattatgtactccatgggctcccaggatccagacgtgcatccctgtgtctatgcagttctgcgtccataaacaggtgaagccagagatgggcagattgcagatgtactgcagggggccagatggcatggccctcataacctctgcacatgtctgcctttctcaaacatgcccatgtttcatctgtacctcccaggtggcgttggcatggaaggaaggactgtgtctgtgagggatgatcatcctctcatgtgatccttggagatgccaggaagccccttgacacatgtggcatgggctccttcagaggcttttggatccgtcgtgaatgtaagcaagcccttcccaaagccctgattttcctcatttgcagaaacaaagattgtgcctggatcaatgatgacttccatatatacattccttggaaagctgaataaaatgaatgaaaactctataccatcatcctcattgaactgaggtcccagcatgctgctacattggagggcaaggagagggggccaacatctgtttgttgacatggtctacaccttggcttaggatgtggtcctctttgggcaaatgcaagcgtctgggctttttggacttctgtagctgagagacagcttggttgaaggaatttcctctgagaaggtggggtaagcacactgccagcctgcagaacttgaagctgcagatggcacaggaagcagtagccagtagtctctttgtgcatgactgtgtgtgtccttgattcatagctttttggtttgtcgcctccccgcttgcacaggaataccattgctttcctttggggagagagcatgtcattcctggacacttgttcggcttactttcattctcagtcgaggatgtgggagttcccatggtacttgggtagcatcaggggcaggcagccatgaggtgggtggtgagctgatttgctttctgcagaggagcccagggagggtatccacattgaactcgtatgtccataggaggaaacccaagtcctttggtccctgcagtgtactggtggtgggaaggggagagggctgtgcatgcatgtaccaagcgacattccatgtgggtcgtggagcaatgactatgagcctcttttgggagttgtagggtgcccatgctccatttcatgatgaccttggggtgctgggatgggaatgagattgcaagtccctgtgttcctgccacttcgcagactgacttggtttgagagatctgtgttcaggaacccctgtgggatgcttgtctgtgttaggcatttgagcagatattggcccagggtttctacccttccatggttgtacatactgctggaagggcttgttgctccctctgtattgatgaggggaagttttgcccaggagagcctgatgccatttgcttctgaactgctcaggcacttcaatgcagttgaggttaagagtgtgtcacttcccatgtcgtggtagcatctactcagaaaagtgacccgtcaaggtctctgcacttaaattctccattatcttatgatgttaggttattttcaaattcctcctaattcttcacaacagtcctctttgtgaaacagtcatgaagttgtatgagggctgtcatccacaggccagtgatggagagttttgtactctgtggccatgttcacaggcaagtggcttaagacgtatcgtgttctcagggacagcaccatagaagccctgtaggattcagcatgtctgatgcttttctggttccctgagctgcacctgtgaggaaggccagaggtggaggttgatgtgtgattgaatgtgtttctcaatgcaaagtgtgtggaaggagcttcaaggccgaaggaaagttgttctttgtgctggaacactttttccctgcagctctccccattgaaatatcctcatggctgttgtcttctctgatggccaagagaatggcttttgagtcaggggtggtgaaagtgtggtattgagagaattcttcgcgcttagtgttctctagtttgatggtgcccttgaaatgcatgcctgccttataccttcatgcctgggtatatctgtgcataagtccccaaagagaggtcacccatgggaggtagatatagaatacagcatggcaggaggaatggcatggcccttgcaaactgtgtacctgcctgcctttctcaagcacacctgtttttcctctgcacttcccaggtggcatgggcatgcaaagaaagacagaggctgcaagggataaacttcatcttgggagatccctggagatggcagggaacccatggacacatgtggcatgggctcctttgggtgccggtggatcccttcatacggtatgtgttcatttctcaaaagaccctaatgttcttcctttacaggaatgaatactgtgcatggaccaatgatgacttccatacatgcattccttggaaagctgaacaaaatgagtgggaactctgtactatcatcttagttgaactgaggtccaccgggggctatagagggacaactgtcattttttttgatgcccgttgcatgaagcattcttccaggcttaggaagggattccgtttgggtgaaggagagtcacaggggagttgaggctatgtgcacaggacttctgtctacaaggctggggtagcacacatgcagtccgtgggactaggtgaatgtgcaggttgctcagggagagttaacctgtagcctgcctctgggtggccaagattgtccttgactcctggctctgggttcccacaacccctggaggaagacaagtaattgtgcttgggaagagagaacaaggccatacttttgcctttctttttttcattcttagtttgagaacagtggagttccaatcacctggcatagctttcatgttgtgttccatgcattgtgagtacatgcatatggcaggaacacacaggttcccactgcaagctgagcctgataggcaaggagtctctagcttaaccccagcccagtgtacgtcaatggcttcctcattaaaattgcatggccctgtagcttttgtgagtgacattataggtatcgatgtaagggtgttgagagggatgctcaatgtcagtgctctttagtgtgctgatgcactactacaagggcacctgagcccttgtccatgcatttctgtgtccaaaatcaggtaaagccagagttgggtatcaaccagatacactgcaggggatcagaggacatggcctttgtgtactgcacatctgtcagattttctcaagcacacccgtgtttcctcttcacctcccacgtggaagtgatgaattggccaggaccatgttggtgagggacaatcatcatctcatgttaacctcagagaagccaggaagctcctggacacacatggtgtaggcttccttggaggctgttggatctctcctgaatgtaagcaattccttcccagtgcaccctgattttcctcatttgcagaaacaaagattgtgtgtggatcgatgatgacttccatatatacattccttggaaagctgaacaaaatgagtgaaaactctataccgtcattctcgtcgaactgaggtccagcacattactccaacaggggctagacagagagggccaacattgattcgttgacatgggtggcaccaaggggaccatccaggcttaggatggggtttctttgggtgaatggtagacacaggggagtaggatctcccatgcacaggacataccttgtttgaaggacttctgtgtcctagggctggataactcatgtgctgtctggaggactaggtgaatggcagattgcatgggaagagttaactggtagcctgcctctgatggccaagtttgtccttgagtccaagctctgggtaccgaagtcccccagaggaagacagatccttctggttgcggggagagcaaaaggctacacctttgccattagttggctcattttatccttagctgaggatgttggagttgtgtttacccggcatagcctctgtgcctatgtgcccatgttgtgtactgtgcattgtgaggatgtatatttggcatgaacaggcaggcttcctctccaaactggggctgatagacagcgaggctctgggttatcccaaaccagatacaggtcaatggcttcctctttaggggtgcagggccttgattattttgtgactggcattgcaggtgttgaaacaagggtattgagaaggatgctcaacatcagtgctctttagcgggatgatgcattctgagggctgccatccccaagatgagcatacttgtgtccataaatttctgggttcacgaacaagggaagccagagacaggcatattccagataaaccacagggggaagatagcatggtcctcgtgacctgtgcacccgtctgcctttctgaagcatgcttctttatcctctgcacttcgcaggtagtgttggtgtaaaaggcaaacccgtgtcatgagggatggtcatcatcttgtgtgatccttggagatggcaggaagccctggacatacatggtgtgggggctcctccagaggctgttgggatcctcctggatgtaagtgattccatttcaaagcaccctgagtttcctcatttgcagggatggagattgtgtgtggatcgatgatgacttccatatatacattccttggaaagctgaacaaaatgagtgaaaactctataccgtcatcctcgtcaaactgaggtccagcacactgctccatcaggggctcgagagagaggaacaacatccatttgttgacacagactgcaccaaggcttggggtggggtctttttctggcagaggagagtagctgggaattttggacgtttgtaactaagagacagcttggttgaaggcagccaggtgtgtcgtcaatttgtaccttgggtcccttgtcctccagaggaagactattgcttccacatggggagacagcacaaggtcattcccagacacctctttcactcactttcatccttgtcaagggacgtaggacttcccatggtgtttggatagcatcaggggcaggcaggcagtcttcaggaggatggcgatgctgatttgctttctgcagaggagcccagagagggtatccacactgaacttgtatgtccataggaggaaacccaaaccgcatggtcccagaagggtcctggtggttagaaggggagaaagctgcacatgcatttaccacacagtcttctgtctgggttgtggagagatgactgtgagcctcttttgggtgttatagggtgcatacggtttattttatgatgatcttgggatgctgggatgggaatgtaattgcgaatccatgtgttcccgcaactccacagacttgacttggtttggcaggtttgtgttcaggccctctgtggaatgcttgtcttcattaagaatttgagatggggctgggcacggtggctcacaccttctgggtgcttgagctgcacctgtgagaaagaccccgaggtggaggctgaattgtgattgagcatgtttcttgaatgtgaagtgtgttgatggatgcttgcagtaaaaatgcttcaaggctaaaggaaaattgccctatgcacaggaagagttttttttttcccaaaactctccccattcaaatatctctatggtctctgtcttctctgatggccaagggaagggcttttgagtcggggcaccaaatgagtggtgtccagagttcttcacatttagtgctctgaagcttgctggtgccctcaaaatgtatgtgtgcctcaaaccttcatgcatgggtactcccatgcacacatcctgaaatgggtatcccatgggaagtagcgatagggtatcccacagggggttgaatggcatggcccttgtgacctatgtgtttgcctgcctttctcaagcacacccgtgttgcctctgtacttcctaggtggtgtgggcatggaaggaaggccagtggagacaatggatgatcttgttcttagcagatcactggatgtggcagggagtcctaggacatgtgtggtgtgggcttcttcaggtgctggtaagtatctattccccaaaaccccctaatgttactcctttgtgggcatgaagactgtgcatggatcgatgatgactttcatacatgcattccttggaaagctgaacaaaatgagtgaaaactctataccgtcatcctcgtcgaactgaggtccagcacattgctcttacaggggctggagtgagggccaagtttcatttgttgctgcaggttgcaccaaggggtttgttcagttgtaggaggggctccctttctgcaaggggtagtcacagggttgtgagatctctcataaataggaaattgttttagggacttctctctgcaaggtaacacacacacaccgtctgtaggactatgtgaatgtgaaggtgacatgggaagacttagcctgtagcctgcctctggtggccatatttgtccttgagtcttagctctgggttccatcattcccttgaggaaagacaggtgtttgtgcttgggaagagagcacaaagccccacctttgctgttttttccactcattttcatcattgttcaaggacattgcagttccggttttatccataaccagggaagccagagacaggcagatagcagatatgccatagggggccagatgacacggccctcatgacctgtgaatgtgtctgcttttttgaagcacactcgtatttccgctgcacttcccaggtggtgttggcatgaggaaaggaggtatcttcgagggacaatcttcttcttgtgcgatccttggagatgccatgaggcccctggacacatgtggtgtgggctcctttggaggctgttgtatcccttctgaatgtaagtgtccactttccaaagtcctgattttcctcatttttgggcatgaataatgtgcatggatcgatgatgacttccatatatacattccttggaaagctgaacaaaatgagtgaaaactctataccgtcatcctcgtcgaactgaggtccagcacactgttcatcaggggctagagagagagacaacatccatttgttgacacaggctgcatcaatgcttgggatgggatcgtctttgggtgaagtggagtagctgggcattttggacttctgtggctgagagacagcttggttgaagctcttccctctgtgtggctatgtgtgttatcgattcataccccttggctcctgcactccccagaggaagacagttactgctgcatggggacacagcacaatgttgttcccaggcacttcttcggctcacttttatcctaagtcggggacatgggagttcctgtggtgtatgggtatcatcaagggcaggcagtcgtgaggagggtggcaatactgatttgctttctgcagagaagcccagagagggtatccacgttgaattgtatgtccataggagggggaaacccaagtcccgtggcccctgaagcatcctggcagtggaaggggagagggccgtgcatgcgtgtaccacacagccttctgtctgggtcacagagcgacgactgtgagcctctttcgggcattgtagggtgcccatagtccatttcatgatgacctcagggtgctgggatgggaatgtaattgtaggtccacgtgctcctgcatctctgcagactgacttggtttggaaggtctgtgttgaggaacctctgtgggatacttttccttggtgcatttgaggtgtctgataatgagtgtgtgggtttctgtatcctggtgacttctactcagaaatgtgacccagcaaggtctctgtgcttaaataccttagtggcttgtgatgttaggttattttcaaattcctcctaattgtgtgtgacaattcacacaagtctttgtgaaattgtccttgaattgtatgacagggctagtgtctgtaggccagtgatggataagttttggactccacagccatgttcacagccaagtggcttaagatgtatggtgttcttagtcatagtgccttggaagccctgtaggattcagcatgtcttgtgctcttctgggtccccgagctgtacctttgaggaaaacccagaggtggaggttgatttgtgattgagcatgtttctcagtgggaagagtgtcaaaggagcctggggtgaaagtacttcaggaccaaaggaaaattgcccttcactcaagaagaggctttccttgaacctgtccccactgaaatatcctcatgggcttcatcttctctgatggccaaaagcaggacttttgattcagaggtggcaaatgaatggtgttgagagagtttgttatgcttggtgctctgtagctggaaggagccctcaaaattattgtgtgcatgatagcttcatgcctgcttacacccatgcacatgtcccagtaagaggggctgcctgtgggagatacatacacgatacaccacagtgggatgaattgtatggcccttgcaatgtgtgtacctgcctgctgttgtcaaacacacctgtttttcctctgaactttccaggtggcgtgggcatagaaggaaggccagtggccacgagggacaatcttggtcttgggagatcctggaaatgatagggagtcccttgatatgtgtggcatgggctccttcaggtgctagtggattccttaggatggtaagtgtccatttctcagaagctccagatattcctcctctgcagggacaaagactgtgcctggatcgatgatgacttccttatatacattccttggaaagctgaacaaaatgagtgaaaactctataccgtcatcctcgtcgaactgaggtccagcacattgctcttacaggggctagagagagagggacaaatttcatttgatgatgcccattgcaccaaggggttctgtccaggcttaggatggggtctcgtttgggcaaaggagaatggcaggggagtggaggctatgtacacaggagattccttgtttgaaggactctatttgtgaggccagggtaccacacatgctgtccgcaggagtaggtgaatgtgcagttgcccaggaagagttagcctgtagcctgcctctgcatggcagtttgtccttgggtcctggctctggatttccatgttccttggaggaggataggtgattttgcttgagaagacagcacagtaccatacttttgttgtttttctgctcatttcatcgtccattgaggacaatgaagttgtggtcagcaggcatagctttcaggccagcgtgcccatgttgtgtcccatgcattgtgagcacatgcatgtggcatgaacacataggctgccactccaagctgagtctgataggcaatgagactctggcttatcctgatcccggtgtagatcaaagtcttcccagtaggattgcatggccccgaggctattgtgagctgcattgcaggtgtggaagcaagggtgttgagagggatgctcaacattagtgctctttagcgagatgatgcactataagggcaccctgaacccagacgtgcatccctatgtacgtgcatttctgtgtccataaatagttgaagccagacagccagattccagatgtatcgcagggggctggatgacatggcccttgtcacctgtgtacctgtctgcctttctgaagcacgcttgtgtttcctctacacctcccaggtagcattggcatggaaggcaggcccatgttggtgagggacaattgttatcttgtgtgagccgcagggataccaggaaacccctggacacaaatggcaaaggcttctttggaagttgttggatcccttctgcatgtaagcagttctttcccagagcgctctgattttcctcatttgcagggacaaacactgtgcgtggatcgatgatgacttccatatatacattccttggaaagctgaacaaaatgagtgaaaactctataccgtcatcctcgtcgaactgaggtccagcacattactccatcaggggctagacagagagggccaacattcgtttgttgatatgggttgcatcaaggggtccatccaggcttaggatggggtccctttgggcaattggaagtcacagggaagtgggagctcccatgcacaggaaattccttatttgaaggacttctttctccctgggcgggataactcacctactgtctgaaggactaggtgaatggcaggtggcatggaaagagtttgtgggtagtctgcctctggtggccaagtttgttcttgagtccaagctctggattcccagaggaagacagatcccctggttgcggggagagcacaagcctacactattctcacttgttagcttgttttgtccttggcggaggacgttgtatttccaggcacccagcatagcctctttgccgcatttccatgtcatatcccatatgttatgaggatttgtgtattgcatgatcaggcaggcttctgctccaagctggggctgtcaggcaaggagtctctgggttattccaaacctgatttaggtcagtggcttcctctttcaggattcatggccccaaggcttttgtgagcaccattgcaggtgttgaagcaacgatgttgagagggatgcccaacatcagtgctctttagcaggatggtgcacctcgagggcccctggccctgggacgagcatctgcgtgtccatgcatttctgtgtccatgaacaggcgaggccatagacaggcaaatagcagatgtgtcacaggggactggataacatggccctcgtgacgtgtgcaacctgtctgcctttctgaagcacgcctgtgtttcctctgcacttcacaggtggtgttggcatgaaaggcaggcttgtatcatgaggaatgattgtcatcttgtctgattcttggagatggcaggaagcccctggaaacacatggtgtggactctttcacaggctgttgaaaccctcctgaatgtaagtgatttcattccaaagcaccctgagtttcctcatttgcagggatgaaacctgtgtgtggatcgatgatgacttccatatatacattccttggaaagctgaacaaaatgagtgaaaactctatactgtcatcctcgtcgaactgaggtccagcacattactccaacaggggctagacagagaaggccaacatccgtttgttgacatgggttatatcaaggcgtctgttcaggcttagaatgtggtctcttatgggtgatgggggtcacaggagagtggtggctcccatgtataggaaatttcttgtttgaaggactgtcagtgagggtgggtaacacatgcattgtctgcaggactaggtgaatgtccatgtggcctagcaagagttagctggtagcccgcctctggttgccaatttgttcttgagtccttgttctgggttctcaggtcccacggaggaaaacagatctgtgtggttgagaggtgggtacaaggccgcatctttgtcatttgttggctaactttgtccttggttgaggacattagagttttggtcaccaggcatagcctatgtgcctttgtgcccgtgttgtatcccacgtgttttgaggacatgtattttgcacgtaaaggtgagctcctgctccaagctggttctgataccaaaggagtccctggcttatcctaaactcatggtaggttaaagccttcctccttaggggttcagggccgcaaggcttttgtgagtggcattgcaggcgttgaagcagtgatgttgagagggatggtcaatgtcagtgctctttagcaggatggtgtactgcaggggcccccagccccgagacgagcatccctgcatccatgcatttctgcctccatgaacaggggaggccagagacaggcagatagtagataaattgcaggggactggatgacatggccctcgtgacctgtgcacctgtctgtctttctgaagcacgcctgtgttaactctgcacctcccaggtagcactggcatggagggcaggcacatgttggtgagggacaattgttaccttgtgtgagctgcggagataccaggaagcccctggacacaaatggcaaaggctccttcggaagttgttggatcccttctgaatgtaagcacttctttcccagagcactctgagtttcctcatttgcagggacaaatactgtgcgtggatcgatgatgacttccacatatacattccttggaaagctgaacaaaatgagtgaaaactctataccgtcatcctcgtcgaactgaggtccagcacattactccaacaggggctagacagagagggccaacatctgttttttgacatgggttataccaaggcatccgttcaggcttaggatggggtcttttatgggtgatgggggtcacaggagagtggtggctcccatgtataggaaatttcttgtttgaaggactgtcagtgagggtgggtaacacatgcattgtctgcaggactaggtgaatgtccatgtggcctagcaagagttagctggtagcccgcctctggttgccaatttgttcttgagtccttgttctgagttcctggaaggaaacagatttgtctggttgggaggagaatacaaggccacatctttgtcgtttgttggctaactttgtccttggttgaggacattagagttttggtcaccaggcatagcctatgtgcctgtgtgcccgtgttgtatcccatgtgtttgggggacatgtacattgcatgaactagtgagctcctgctcattgcttctgatacccaaggagtccctggcttatcctaaacccaatataggttaaagcctttctcattaggggcccagggtcccaaggcttttgtgagtatcattgtaggtattgaagcaacgatgttgagaaggatgctgaacatgctctttagtgggatgacgtactctgaaggctcctgacccccagatgagcatccttgtgtccgttaacttctgtgtttatgaacaggtgaggccagagacaggcagacagcagatgtattgcagggagctggatgacatggcccttggaacctgtgcacatgcctgcctttctgatgcacgtccatgttttctctgcacctccccggtggtgttggtataaaaagcaggcttacatcagcaagggatgattgtcgtctcatgcgatcctgggagatggcagaagtcccgggacacatggagtgtgggctctttcggaggctgttggatccctcctgaatgtaagtgattccttcttaaagcatgctgattttcctcatttgcaggggcaaggactggatcgatgatgacttccatatgtacattccttggaaagctgaacaaaatgagtgaaaactctataccgtcatcctcgtcgaactgaggtccagcatactgctcatcaggggctagagagagggacaacatccgtttgttgacaagggctgtgtcaacacttgggatggggtcgtctttgggtgaagtggagtagctgggcattttggacttctgtggctgagagacagcttagttgaagcacttccctctgcgcagctatgtgtgtccttgattcaaactccttggctcctgcactccccagaggaagacagtggcttctgcatggggacaccacacaatgttgttcctgtgcacttctttggttcactttcaccctcatttggggacgtggcagttcccatggtgtttaggtagcattgagggcaggcagtcctcaggaggatgttgatgctgatttgctttctgcagaggagccagagagggtatccatgttgaacttgtatatccataggaggaaaccagtcccatggcccctgaagggtcctggcagtgggaaggggagaggtctgcatgtgcatgtactggacagcatattccatgtgggtcatggagtgatgactgtgggcctctttcgggcattgtagcaggcccccatttcatttcatgatgacctcggggtgctgggacaggaatgtgattgcgggtccacgtgcttctgcaactcctcagactgacttggtttggaaggtctgtgttcaggaccctctgtgagatgcttgtctccattaggcatttgagcttatatcggcccagggtttctacctatcgtaggttgtgcatactttgcctctgaaccactcaggcacctcgatgcagtcaacgtgcccgattataagagtgtgacttcccatatcctggtgatctctactcggaaacatggtccaggaaggtctctgtgcttaaataccttagtagctcgtgatgttaggttattttctaattcctcctaattcttcccaggagtcttctttgtgaaatagtcatcttgttgtaggacagggctggtatccacaggcagtgatgcataggttttgcactgcgcggccatgttcaaaggcaagtgccttaaaatgtatggtgttctcagccacagtgccttagaagccatgtgggattcagtgtgtctggtggtcctctgagctgcacctgtgaggaagacgctgaggtagaggttaagttgttattgaacgtttttctcaatctgaaaagtgttcaagcagcccagggtgaaaagtcttcaagactgaaggaaaattgccttttgtactggaagagtttttccccaaaactctcctcatttaaatagccctgtggcttgtgtcttctctgatgaccaagaggagggcttttgagtcagtgatggcaaatgagtggttttgagagagttcttacacttagggctctgtagcttgatggtgccttcaaaattaacacgtgcctgctatcttcattcctgggtagacccatacacccatcccaaaaggggagtagcctgtgggaagcacatatgggatataccacagtgagtcgagtggaatggcccttttgacatgtgtacctgcctcccgttcttaagcacacccgtttttcctctgcacttcccaggtgttgtggccatggaagtaaggccagtggctacgagggacagtcttcatcttgggagatccctagagagggcagggagccccttgacatgtggaatgtgatctctgttgggtgctggtggatcccacaggttggtaaatgtccattttccaaaagcccctgatgttccttctttgcagggataaagactgtgcatggatcgatgatgacctcaatacatgcattccttggaaagctgaacaaaatgagtgaaaactctataccgtcgtcctcgtcaaactgaggtccagcacgtggctccaactggagctggagagagagagacaacttccattggttgatgtgggttgcactaagccatccatccaggcttaggatggggtccactttggatcaaagggagtcacagggcagtaggtgctcctgtgcagaggagattccttgtgtgaaggacttctctttgtgaggctgggtagcacgcacaatgtctgcaggactgggtgaatgtgcaggtggcacagaagagttagccggtaacccgcctctgtgtggccaggtttgtccttgagtgctggctctgggttcccttgttccccagaggtagatagctccttgtggttgggaagagagcccaaggccacatctttgttgttctttggctcattttttttcatggctgaggactttttagtgcccatggtgttttcgtagcagcagtggaagtcagttgtgaggaggttggtgatgcttattttctttctggagagtaccctgtagatcggctccatttatgatttgtgtgtctccagggagaaactgaaatcccatggctggtgatggatactccaggtgggaatgagaaagcgccatacatgtgttgacttggtaccctaagatggggatggtccgccacatttgcgcgtctgttttgcatggtgtgtactgcacatcacaaatgccatgttggccttagggtgctgggaatggaatatgatctgatgtctacatgggagggcctttcagcagattgcttttgtttcctgacagtctttgctccatccccagtcacacgtgtttttctccagggaacattttattggagtatatcaggtcgatatcagaaaaaaaaatgttgtggttatcccaacattaagtgtggtgatgtaacagcagtgtggatggtagctcaagtgaacagtggcaaaaccaaaatatattggtttacgtaagtgaccctattctctcctatgtttgaagtctggtatgcatctctttctgcaataatctcagtgatctggaaactttcaggaggtcttttttagatattttatgtccttgtggttgtactcatactccctgcagtgctaagtctgagtcattctgctatcctagtgctactggaatttctattgttttgggggcactgtctggtcattgtggatacctctcttggggccctttaataagaagtatgttagaggtcggttttggggcagtgttgacctcctgcctaaggtcaaaggcagttttcttcctaaatcttattgcaggattcactgcctgggggttgtgtgacagggagagcacaaaattagggtatcccatgtggacttgtgtccagtatcaaggcagtgttggataattttctatatccacaaggctcccactggactctttatgtccagcagacattcacaggccaacttttctcttacacagggggcctcattcctgccatgtgtagcttccatggaaccatccttcaggttttaagtgcaaggatttctctcaagagtttaatttgtttctttaagacaccgttttcttttctataaattctgctttctgtggtttgtagcacagatgaaattgccaggtcatattctacatttctgcccaatcttggattagtgagcctttgaaatatgttccttgatcactggcaatggttcttggaataccagaacttagttacaagcattgcagacctacagaggtttgttgttatttttaactgcatgaagcagtgggtttgtttgtatcttgtcactcacggctgtcagcaaaacttaggtgttgctaaaccagaccacacccatgaattatagtgcctctggttccttctgtagtagcctgtgggaagtagatacaggatgcaccacaagggaatgaatggcatggcccttgagacctgtgtacctgcttgcctttctcaagcacacctgttttgcctctaattcctaggtggtctggcatggaagaaggccagaggctgcgatggatcatctttgtcttgggagattcctggagatggtggggagcccctgggcacgtgcagcatatgtggcgtgggcttcttcaggtgctggtggatccctcaggatggtaaatgtccattttccaaaatcttctgatattccatctttgtaggtacaaagactgtgcatggatcgatgatgacttttatacatgcattccttggaaagctgaacaaaatgagtgaaaactctataccgtcatcttcgttgaactgaggtccagcacattgctccaacagtgggtagatagagagggaaaacttccatttgttgacgcaggttccattgaggggtttgtccaggcttaggatggggtcccctttgggcaaagggagtcacaggggagtgcggcctcctgtgcacaggagattccttgtgtgaaggatttacctctgtgagagcagggtagcacacataactatgcaggagcaggtgaatgtgcaggtggcacaggaagagttagatggcagcctgtctctgcacagcgaggtttgacttgtcctagctctgcattccctcatcccttagaggaagttggtttcttcagaagacttaaatttgtggaattcagtagaatattatccacataatgttcccagtgaatgctaggcatatcacccaagatggccaggcctctggccataaaccatagtaaatagtagggtgtgcatatatccattagggagaacctgaaaggtccttttttggccctccaaggtgaatgcctgcaaaagcaagcgaagcacgctatctgcctgcatgagccccatgtacctggcgtggcctgtgctcctcaccgtgtgtcccacttctgctgccccttcgccttgccaggtggagtctgactgattttttgccactgctgccaccacaggccacctggagccccagccagtttgaggaaagtggctctgcttgattttccttttttctttttttttcctctttttttctccatttctgacttcagcaggtgggacttggagcttctgcttctgcagccacagaagactccccagtttggagggctgtggttgtgggctccctaagcatctctctgcagagcctctttgttttccattttacccaccatgtcaataatttaacacagtggcggaggagttcatgtctcttcctatttgtcattactcttctaactttcacagctgtactcggctactggtcagaataagagaaaaagcagtggaaccaggaggatcctacaagaaatattccatttcacttttgtttgtgcatataccttttctgtttaaatgtggacttcgatttgatatgcttccagtgcagacacagatcccatatgtaagagagtatggagttgcatagaaagaagacttgtcattttcctgtactgttggtgttctaatctgtcttcgtggtttttgcctcttctggctttagaagatacaccaacatggttttgcaacatagcctcttcttattttagtaagggaccaaatgtgcatgtcagtaacaggtgttaccttgaattgggatcagtgcttgtgtgactatattcagtgatgtcattttctgtcacactcaagtcacaaaatatttaaccacttatttttttatctctggaggaataatccaaaagattgtactggtaaagccagaacaatttccaattatgctaattatttgtataatacttagttggctttatctgtggtttgttggcttattttcctgtagcttttcaaggtttttctatgagttctgttaaagagtctgaaaatggagcgtagaagacatgcttcgatttccaggatggttgtgttttccagagaggcggaggtaaaccactggcgcagccctgcctcccacagataattccgggtgcagtgtttcatatctagacttggacttctatcctaccatacttctttgtgtgcaggtatttttggggataaaatccttgttttcagctgtatagatgtcttgcacatactcttttgatggtttgatttatccattgtgttcagcacgtttcagtgagcaagatatgggatttaatttccaatataaaatccatgactgctggccgggcgcagtggcttatgcctgtaatcccagcactttgggaggccatggtgggcagatcacgaggtcaggagttcaagatcatcctggccaacatggcaaaaccccatctctactaaaaatacaaaaattacccatgcgtggtgttgtgtgcctatagtcccagttactcaggaggctgaggcaagagaatcccctgatcctgggaggtggaggttgcagtgagctaagatcatgtcactgtattccagcctgggcgatagagactctggctcaaaaaaaaaaaaaaaaagaatgttataattattttcagcctcatgtctccgtgtcacacacaggtccatgaagctgtgttctttttttttttttttttttttttttcagagtattttctttcttgtccagattagctaaattggattgttctatgctaaattcacttaatcactactctattatttttgaattttttagttctgtttttttcacttggttctttttttaaaaaaacttctactacctttctgagacttctacttttttacttttttcaagaagctttataattacttgctaaagcatttttaccatgactgtttttaacttcttcagataaccacaacatttggttaatcttgaggttggcttggttaactgtcttttctcatcctgcttatgattttccttctaattgtgatttttccggttcttgatagatgggtgatgttttagtttatcctgcatttttttttcctttttaagttagaggaatctgaatctattcaaatgttttattttagcaggcatgtgccctgtttaggtttaatttgaatgtcctgtcctacttttgtaggccatgttttcgcaggcagtcttgctatcagagctgaggggatgctgttttgatcacttagtttatctgatgttgctgggcctccaactggtgctgactggtacttcctgagatggcgaaggtttttctgtactctgagatgccgtgtatctctatgtaaggggaggagactctggaccacaggaatgaagagaacatcttaggtcaggcagctcaatcatatgcgataacctgggtcaaccagccagtagcctcatgaagtatgggagggaattctccagtgtcagcattcaaagacatcatgagtttttacttctcattttcttttaagtgaaataatcgcatggaaattaaagaataaatatatgaaatatatgaaacttatatgaaatataagaatgtgagaaggcctacagcgtggggatccccaggctatttgaacaatgaatgtctgtgttacacatctttgctcactttttctctatttttgtagttcattgtggaaccagcacagattttcatacgaaagttatttctttttaacctcaaaaagtgacagaatggagtgtatcatgaaaaagtctgacatcaaaacctcaaaatgtgatattggtaagcattttgtcctgagaataccagcatttcctcttaggggatcatgacactgcagtgaccatgtgaccctggctgtgctagtcagcctgggctgttcattgactgtgatgctggtctccatgtgattgactagtgtgggtcagtgcctccaaaggtgacagctgtgtgctcagtgtctgccacatatctcaggctcaaggtcccttttataaatgtgcctggatcgatgatgactttaaaatggatctcatcggaatctgaacaaaatgagtgaccaaatcacttctgtgccacttctgtgagctgaggtccagcacaggggccatgccagacaaacacatggagggtgttttgtttggtcagcactggtactatgaaacggcctgtggaattagacaactaaccagctcacatacagtacaggaaattactggacagttaacctaccaatatatggttgggggtaagacggagacttttcaaatgcttggctggtagcatctgtacactacagtgaccagacactgggagccagcacaggagttataggatttacaggaaattattgtgtgaacccacaagccattcagacatttgtgtgagcgcccagaatattctggttgatggtttgttgcttgatggcaaagagatgtcagcattcaaagacatcatgagtttttacttctccttttcttttaagtgaaataattgcatggaaattaaagaataaatatcttatatgaaatatatgaaacatatgaaatataagatatttatttatatcatataagatataaatatctcatatgaaatcttgtagtatattttcatttgattgccaacccagtcactaggactgaaacagttgtttattttttgttttcccatcaaccaagcaagctatttaatacatgtttcagtgctggtttcaactacatgttgcagcaaacatttttagaagtgatatttcaaattcttggattttcacatggatttcattgtctactttcatatgtcctccatgtgtgaccactgtattaattaaaagttgtaataaatgattttgaaaggtatgtgctggaggaacttcgggacaaatgttttagaaaacattatttccataaaatttggatcaaagatgtgagcataattgttcttgttatacagatggtccaatgagtgtctaatgtgaattcttataactgtttataacaaagtagtccatgaagcaaattttgtttcacaactttcctaatttcccctgtactctgtagattgggtgagatagaattccatggaatttcattgccaaaccagtgaagtgctaattttgacatttgtaccagctaacgtagctgtgaagaaacacaccaatacacttctaaggtaacattcaatttttagtgaatttatttttgtgagttatttttattcttttaagtaatcaagaatttatgttcacaaggaattggttaatactaacagtttcagacattaatgttctgatgagctgaggcatcaatctccttttgataaaggttttgttcttttctctactttgaataacatatgaaatgtccaacagcagttctaagttagtgtatattccatatatgttaatagtgaaacatcctgtcttatgcaaggctaaaaattgtccgtgtatacttctcagatttgtatacatactctcttcctacaggacagcatagaccaagatctaggtttcatatggatgaatttattcttccctttgaggcaagacaagaaggaaagaaagtattgggaataatgctgccctcccatcctcaagggccagtgggaactctaatattggtaagccttttgtcctgaaaataccagcatttcctcttagggaatcataacactctgctaaccgtgagactctggctatgctagtccgccatgggctggtcattgactgtgatcctggtctccatgattgaatagtgtgggtcagtgtgtcccagagtgacagatgtgctcagtgtctgccacatatctcagactcaaggtcccttttataaatgtgcctggatcgatgatgactataaaaaaaatggatctcatcggaatctgaacaaaatgagtgaccaaatcatttctgtgccacttctgtgagctgaggtccagcactgggaccatgccaggcaaacatgaggagggagtttacagggactagggtattggaaaactaacctacccatatatattagagcaaatgaattgttctcagttctgtaaatatccagctgtggtttgacatagcaactctctttgtatttgcttggcagcatttatagaaacagctggtagaccctggggaaccagggcatagtgagattcatgggacgttatttcacctactcttgagccattcacacatttgagctcgcagaattatctggtcaatgagcagtctcttgagggtaatgagatggtcaacatccaaatccaaagatactaatgagattttacttttttttttgagatggagtctcattctgttgcccaggctggagtgcagtggcataatctcggctcactgcaacctccacctcctgggttcaagagattctcccgccccagcatcctgagtagctgggattacaggcgcccgccaccacccctggctaatttttgtgtttgtagtagagatggagtttcaccatattggccaagctggtctcgaactcccaacctcaggtgatccagccactgcagcctctcaaagtgttgggattacaggcatgagccgccgtgcccggccttactttttattttcaattaagtgaaacaattacatggaaattgaaaaaaaaaaaaggtactctaagtagactactctagtgtattttaattttcttgccaattcagccactaggattgtgtcacttgtttttttgattttagtttttcgtatcaaaaagcaaaccactgtttatatttgagtgctggtttcaactgtatgctgcctcaaataaacttagattatattacaaattcttttttacatagatttcattggctatattcatatatcctcaaaggtttccattgtgtttgaagaggtatcctaattgtaataaatgcttttgattggggatgccagggaagctttgagactaatgtctcagattttttttaaaaaagtttatattctatagtgatcaaagatgtaagaataatttttcttgtcattcattggatagtccagtgagtgtctactgtgaattcttatattcacttgtaactaaacattccatttggcaaatttcgtttcataacttccctaatttcctctacactttgtagattgggtgagatacaattccatggaattttaccactgaaccagtggagggctaattttgtcatttgtaccagttaactaacttgggaggaaacagaacaacacactcctgaggtagtatccaatttttagtaaatttatttttattatttttcaaactgtcagtgatttggtttggtgaacaataggttaatacagacaatgttaggaattattaatctgatgcgctatctgaagcatcagtttcctttatttttaagatttttttcttctctgtagtttggataatatttaaaacatttccaagagttataaattagtatattttctatgctgattaataatgaaaccttttgtcttatacagatttttaaaaaatggacgtgtgcgtgcatgtgtatatatataaatatatatatatataaaatctcttctcacaagatgatgcagactaaaactgcattttacattttatatggctaagtttattgtttccttgtgttgtaatatgatggaaagtaatgggaataattctgcttcctgtccttagggaccagtaggaattttcccatgataagcattttgtccttaaaatactgacatcctgttaagagatcatgacactccaatgaccatgagaccctggctatgctagtcagccagggggctgaccattgacagtgatgctggtctccatgattaaatagtgtgggtcagcatgtcccagggtgacagaaagctgtgtgatcagtgtctgtcacatatctcagactcagggttcctttttaaaatgtgcctggatcgatgatgacttaaagatttatctaatttaaatctgaacaaaatgagtgaccaaaacacttctgtaccacttctgtgagctgaggtccagcacagagaccactccagtcaaacatgtgttgcctggagttgcaactagttggtcagttagaagcaaccacagggactggggtatttgaaaaccacttgagtgcatttattagaggaaacgaattttacatttgtgtataaaaattcaattgtagggtaaaatggaaactctgagagtttggttggcggcatctatataccatagaaacagagcctgggaagcagaacagtgagacccaagagaaatgttcctgcctatacttggtctgttctcacatttgcctgagctactgattgatcttttgagggtgatgagatggtcaaaatccaaggatatgatgagtttttacttctcattttctttttttttttattatactttaagttttggggtacatatgcagaacgtgcaggtttgttacattggtatacacgtgccatggtggtttgctgcacccatcaacccatcatctacattaggtatttctcctaatgctatccctcccctagcccctgaccccccaacaggccctggtgtgtgatgttccctccctgtgtccatgtgttctcattgttcacctcccacttatgagtgagaacatgtggtgtttggttttctgttcttgtgttagtttgctgaaaatgatggtttccagtttcgttcatgtccctgcaaaggacatgaactcatgcttttttatggctgcatagtattccatggtgtacatgtgccacattttctttatccagtctatcattgatggacatttgggttggttccaagtctttgctattgtgaatagtgccgtaataaacatatgtgtgcatgtgtctttatagtagcatgatttataatcctttagatatatacccagtaatgggattgctgaatcaaatggtatttccagttctagatcctagaggaattgccacactgtcttccacaacggttgaactaatttacactcccaccaacagtgtaaaagtgttcctatttctccacatcctctccagcatttgttgtttcctgactttttttaatgatcgccattctaactggcatgagatggtatctcattgtggttttgatacacatttctgtaatgaccagtgatgatgagccttttttcatgtttgttggctgcataaatgtcttcttttgttttacttctcattttcttaaagtgaaacaatttcatgtggtatcttccaagtatattttaatcagttgccaacccagctgctaagattgaactgtttcttttgttcttctcttgtttttttctattaatttagcaaacaattttatatatagtttgctatccttctccatggggcctgcatcttcagattcaactagccatggattgaaaatacttgacaaaaaattgtatggtttcatctgtactgaacatgtacagtctttttctctctttttctctttctttcttttttttttttttgagacagagtttcactctgtcacccaggctggagtgcagtggcacgatctcagctcactacaacctctgtcccccgggttcaagtgattctcctacctcagcctcctgaatagctaggattacaggcgcccaccactgtgccaggctaatttttgtgtttttagtagagatggggtttcaccatgttggccgggctggtctcgaactcctgaccttaagtgatctgcctgcatcagcctcccaaagtgctgggattacaagcatgagccaccatgcccagccaagtacagactttttctttggttattattccctaaaacagtacagtataacaactatttacgcagcatttacattgtattcagcatcatgagtaatctagaaatgatttcctgcatataggaggatgtacataggttctatgccaatagtgcacagtgctcgctgtgtttaaagaaatatcctaggtatagaataaataattttgaagtcagtgtgttgagaaaacactgacatggatagaaaatattctgtctagaatagaaaaaacaatagaatagaaaaagttctatctgtatcagtctgatcaaagatgtgagcataattattcttgtcatacatatagtctaatgaatgtctaaagtgaattcttataactgcttgtaacaaaatatttcatttggcaaatgttatttcacaactttcctaattgcccatgtactttgtagattggttttcacagaattccatggactttaactgctgaaccaatgatgcactgattttgtcacttgtaccagctaacgcatctgggaggcaacaaaacaatactctcctgaggtaacatcgaatttttagtaaattcatttttgtgtgttgtttttattatttttttaagtaattgagaatttcattaggtgtgcaaggagtcacttaatacaaatagtattaggcattcaatactctcatgagatatctgagccttcagtttcttttattttaacattttacatttttctcaactttaacatcagaaacatcctataagtgtaataaaattcttatactttacatatagttacatagtaaatcctcctgtcttatttaagtttgaaaaatgaacatgtatacttctcattcccatgtatataatctcttcccacagaatgaggtggaccaagaaactgggcttcatacggatgaatttatttttttccctgtgtggagacataaaggaaaagtatagtgaataattccgcctcccacccacaagtccccatgggaattctcacatgttaaaaagcattttgtcctgaaaataacaacaatttttcttagggaatcaggacactccaatgacagtgagactctggctatgccaggcagccatgggctggtcattgtgctgctggtctccatgattgaatagtgtgggtcattggtgacagatagctatgtgctcagtgtctgccacatatctcaggttcaaagtcccttttataaatgtgcctggatggatgacgacttaaaaatgaatctcgttggaatctgagcaaaacgagtgagcaaaccacttctgtgcagttctgtgaactgaggtcaagcacagggaccatgccaggcaaacacgtgcagagagttcagtttggtcagcaactggtaccaaaatggcctgtggtattggaaaacaaacccactcacatagcttacagcacatgaattgtacagaggtctgtatgtgtttgtatatatttatatatgtttgtgtacatatatctttggggattatatggcatttctttcagtgtttggctggcagtgtccatactctcatagtaaacagaattacacaagagtagagggaacagtaggaaatggttttgcctaccctagagtcttttatacatgtttttaggtgctataatcttgtgtgtgaggtcagtctctcaggttcattagatggacagtgtaaaaggtattatgaggttttacatattatttatctattaagtaaaagaaatatatggaaattgaagagtagcttttatctattaaagaaaagaatgtatggaaattgaagggtactttctatttgtggaaagtcttaacattttaatttccttattgatcttgtcacagaagttggaatttaagttttgcctgtcactcaaagagaagctttttagacatttgattaagggattctagtagatgctatagtaaacatttctaattgtaaaatgattaaatttgcaattcatagagttttatgtggatttcattgcctgatattcattatttttattagtgggtttcatagatgtttaaagggagatcctagttttattgtgtgatactaagggaggccttttggtcttagaaaactgactttcagtactacccatttccagggagtgagcataatttttattctcataccacatgggcaagtgaatatctatggtttatttcttataactcgtcattagtaattatgaaagtaagaaagttgacaaatgaaactcttttaattatgagggtttcatttgtcgacttcctacttcctcagtgtgctttgtgtattggaggtaatactggaattgcatggaattcctactgctgctccagtaacctgctgattttgtcacgtgtaccagattcgttgtctggcaatgagaacaatacacttcagaggtaatattgcaatttttagtaagtgcatttttcctgggttcgttctattattttattttagcaagtaagattataattggtttttcaagcagtctgttaatccaaatggtgtgaggccctaataatctggttagtcatctgaagtttctgtgttctttgtacagtatttttatacttcctctgttttcaaataacattaggataccctactagcaaaataatttagtatattttatatacttgtgcatagtaagcctgttgtatatgtacactatttgcatggttggcaaattacatttgcactttttatttttctataattttttcctattttcaaaggttaatgtggaccaaaaactagatttcatataaaagagtttattccttctacttgaggtgtgacatgaaggaaagtaatggaaataattctgccctcccattctcaagggccagggggaattcaaatattggtaagcattttgtcttgaaagcaccaacattcttcttagggggtcatgacactccaatgacaatgagaccctggctgtgcttgtcagtcatgagactggtcactggctgtgatgctggtctttgtaattgaatactgtgggttggcaagtccccaggtgacagaaagatcagtgttcagtgtctgccacatatctcaggcttaaggtcccttttataagtgtgcctggatcgatgatgacttaaaaaaatggaaaccttggaaatctgaacaaaatgagtgaccaagacacttctgtgagctgaggtccagcacagggaccataccaggcaaacccgtggagggcgttcagtttggtcaggaactggtaccaaaacgaacccacttgcatatgttagagcagatgaattgtacagaggcctatatatcttcgggaattacatgacaatgatttaagtgcatggctgacagccttcaaacacctagtaatcaggctttggggtaccagcgtcagaggagtgaacactgtagaaatggctgtgccagcactcgagtcattcacactattttcgtagacgccacaacattcttagtgagtatcagcatgtataggtatattatgtagtcaattagaaagaaattatcagtctttgcttgctatttattctttcactaaaagaaatatgtgaaaattgaagagtgggttgtattcatgggattatcttattacatgctggaatttgcttcctaactcagtctcaaggattagaacagcatttgtttttctttttcctgtcactcagggagcaattttctaagcattagatgatagattaaattagatgcttcattaaacattttaatgtgaaataatgaaatttctaattctagggattttagatggatattgttggctaataggaatattccttcattgagtctttgtatattttaagagagattctaattttagtaatactcggggcctttggccttcgagaccaaaatcttggaaacattgattttctgtacttaccctgttccaagcaacaagcagattttttagttatgtggatagtcaagtgactatggctaattaattacaaactgttgtcaggaatcattcagttgggaaggttttgtttcaaaactcctgtaatgtcccctgtgccttgcagaacggaagtgattttggaattgcatggaattctcactgccatcccaaagaaatgctgatcttgtcactcttacctgtttcattccctgggggcagaacaaaaggacgcactccaaaggtaacatccaagtttgaataaatttactttttatggcttattttgtaattttttctgtagtcaagtagataatcagttttgtgaatgatctgttaataacagtatgagacattaattatctggtgaatcatccaaggctttcattatcctttatttccaattttttttgcgttctccttttcagtaatatcaaaaacatcctagtagagttatgttagtatatttgatattaatatacataacaaacgctcccttcttgtgcatgtttgacaaatggacatatatacttaccatcttcccatatttgtactgttttcacagatcggcatgaaccaagaactgggtttcatataaaatattttattctgtcctcttgagatgtgacatgagaaaagtattgagaatacttctatcacctcatcttcaagaatccgtaggaattctcccatggtaagcattttgtcctgaaaatactggcattcctcttaggagatcgtgacactccaatgaccatgagaccctggccatgctagtcagccattggccagtcattgactgtgatgccagtctccataattgaatgaatagtgtgggtcagtgtaccccaagctgatggaaagctgtgtgctcagtgtctgtcacatatcccaggcttaaggtaccttttataaatgtacctggattgacgatgactttaaaaaaaaaaaatctcattgaaatctgaaaaaaatgagtgaccaaaccacttctgtgagctgaggtccagcacacatgataggcaaacgtggagggatgtggatggtcagtgcccacagggactggggtatttgaaagctaatctgcctgcgtatgttagaggaaatgaattggacagtcatctataaatatcgtattttttaataaaatggctattcctttggtgcttggctggtagcatccatccactggtagtaaatagaccctggaaaaccagcacatatgtagtgagaccccatgagacatgattgtgcctacctttgagccatccataagttatctgggacatgacagtcttttgagtgagagcagtttactaaggtcatttagatcatcagttccaaagatggtgtggatcttatcgattatttttttaggcagaggtaatatctggaaaattaagagtgatttctaaccatgagaatattttagtttgtttaaatttgcttgctaacccagtaccaagaattcagaccttttttctgtctgtataaagcaatattctagacatttgagtgattcaagtagatgttgtgagatgattacatttccagtccttggaatgttatgtggattttattggctaatcttcatatttcatcagtggattttcctatgcatgttaagggagatccttgttaattgatgtctaggtggactttacggttaacctgaacaggtcttggaaaaaggactttaaacattctcctgttctgtggaataagtatacttttttctggacatacaccttgtcagtgagtatgtatcataattcctcataacttcttatcaggaaacattcgatgtagaagatttctttctcaacttctctaattgcccctgtggtttgcaggttccatgtgatactagagttgcatagatttttaacctttacgccaatgaagatctgaggcaaacattgccccttttttagaagtttgcatttgtcactgataactgtaataattgatcttgttgaaaagcctgggaaatgaagatctgatatgtcacttttaccggcttcctcaactgaaaaagaatacaatgaaacacgctgaggtaacatctaatttttgatatcttttttcctgggttattactgttttaagtatttaggaatttaatgggtgctatatggagtcagttaattcagatactataagaccttaatctggtgagtcatctgaggcttctgtttgttcttttccagaatttttgtgctttctcagtcttgctgatgatctttctatgggcctgaagcgtggagagtgccagagaggctgatcctcagcagtgtggcagaggaaagttgggtgcgactaaggggtatgcggtgcccacatgccactgggtcctcagcagtaccacctggtgagcgtcactcttgagagctgagagtaggtgggaagcagctcatggtgagagggttcagaggccgcctttccctctctgcgcactgcccagttcttctagtcacatgtcccgggacagtaccatacctgtgtgtgtcctgcctgcattgctgtgaccacttttagtggaatcaggtgcagtgcagctctgcagcttctgcaaattgccacgctcccactctcaagcaggttgagtgctacgagtgatttttagaccatttgtttattcccttatcatggctttttgtgacttcttcctccccagtccgttgggtcacctttaaaggtaaagtaatcctgaggtggttgaatttacggaaatgctatgcattattgtgaatgggatgttcaccgggccaacatcttcttggaactttgagcaaactgatagtctggttgcacatttgatttgtctggcagtaaatgttggacagtatttggactgatggaagctagagacaaacacattgactattgttgaataacactggaaacatcttaggagagcagtacattagctaatttaataggtacataaactgaatcccactgtcttgtgcttgacggaccagcagacacatatgcttgtatcgttctcatgtttctacatgtttaccctattcccacaggtcaacaaagacaaggcacctagccccacatgaaactttattcctttcccttttgagatgtgacatgaaagaaaataacagaaatgatttttccatcccatcctcagggaccagtgggaatgaattttaccatcccaccctcaagggccaggtcaggtcgctaagcattttgtcactaaaatattgcccttttttagggattatgtaatactctataaggcactgtctgtgctgggcagcatggagcctgggtcattgctgtgttgggggcttggtctccatgacttaatagggtgtatcagtgtgtcccagagaagtgtactccagagtgctcattttctttcatgtttctgaagcaaacagtgcccccttttttagaagtttgcatgtgtcactgataactttaataattgatcttgttgaaaaacctgggaaaacagtgagttaaataataacttctctgaacatgaggtccagcccaattacctgccctaagcaaactatatggaaggagagttcagtttgttcagctatgtggtcccagcaaggactgtggtactggaaaactaaccagcttacatgcactagagaagtagaattggacagtgatctgtaggtacccagtttggagatgaaattgcaactctgagttcttgattggcaacataaatacgttgatagtaaacagaccctggggaatcagcacttgagttgtgaaaagcgggaaatagctatgcctacactagagccattcacacttttgctggagctgcaataatcttctaagtcatgcttgctctcgtgagggcaatgagatggtcacaatccaaggagagttggggttttcacttttcatttctctattaagtgaaaaaagtatatgaaaattgaaaaatagatattacttatgtaatcttcacagtataatttgcttgccaagcagtcactgggatttaatcagtttctttgtctttcgtttttctcataagctgagagagtaattttgtgtgcacagaagtactgtcttcagctacatgctgcattaaacattcctagatgtgaaatgattaaatttccaagtttttaaaatgtggatttttctggccacttttatatctcttcaatgggtttctaatggatttaaggagagagcctagtcatgatgaatggtgttgtgttgggtatgctgaggaaactttgagaccaatgtttcagaaaaaattatttctatactgtcatgtttcaagtaccgagtattgttcttgtcatacagatggtccagtgaacatctctggtgaattccttacaaccaacctcttgttactaaatattccattaggaatgttttgtttctcaactccctgatttcccctttatagattggaagtgatattggtggaagacaacattttgccgcttggaattctcacctccacaccaaagaagtactgtttttgtcatttgcaccagcttctttctccaggaaagatcaaaacgatgcactgcaaggttaacatccaatttttaatacatgtaattccctggattatttttgttgtgttattaaataacttagaattttttttacaaagtctgttgaaccaaacactgtaaggcattaataacctggtgagttatttgaggccttttttcctctcctagaatttttgcacaatttatattttgaataatatcagagacatcctagtagagtaatgaattagtacattttatatgcagatacatagtgaagcctcctttcttatgcatatttgacaaatggacatgtatatttctcatcttcccatatttttactccatttccacaggtcatgtagaccaaaatgtgaatgtcatatgaaagagtttaaacattgcccttgaaatatgacagaaagtatcagaaataattataccattccatgctcacaggccagtgggaattctcacagtaagcattttgtccagagaatattcttcttagggaactataacattccaatgataatggtagtcagccatgtggctggatcatcgttcctgtatcctggtctctatgacttagtgtggtgatggtgtcattgtgtccaagtgtgacagaattgttagtgtgtagtgtctgtctcctatctcaggctcacagtcccttttataaacatgcctggattgatgatggcttcagtatcttttggaaatctggactgagcaatagaattgcttctctcaaattgatttcaagtcatataaaaggccatgttacacatatattgttaatctgagggaggctgtgatcatttaagttgtattttataaacactaggaccaccagtaagaaaacaattcaaaaaatattaaaagaacaaccaaagaattaaaatagaataaccgaaaagatctgtttaacacaaaagaaggcagttaaagatgaacagaggaaccaataagacatatagaaaacagataggaaaatgacagacataaacccagccatatgacaattatattaaatttttaagagattaggaaattccgttgttttttaaacatgagcaactatacgctgtctacagaagagacactttagaacaaaagatacaaatagttggaaagtaaaaagatggaaaaagctatatccagcgaatccagaagagagcagaagtggctattctgacatcagaaaaaagagactttaagataaagtattgctagagaggaagaaggatagtatttaatgatagaagggttaatatggaatatgtaacaattacaatcatatcagcactaacaacagtgcccaaaactacatacactgaaatttaacatgattgaggggatcaataggcaattcaacaataaaagcttttgttcataccctcttcttaatcagtgataagtcaattagatagagcatcattgaggttacaacatacttcagcaatgttgtcaaccaatttgacctgagatagatagatagacagttagacagacagacagacagacagagaaaacttcacccaacaacagaaatacaaattattttcaagcatacctggaacattctccaggatagagtatatgttaggctataaaactgtactcaataaatttaagattgaaaccatgtagagtatgttgtgtgaccatagaggaattagaaatcaacacagaaataaatttggaggtcacaagatatttggaaattaacacactttacagagcccattggtcaaaaatatatatattaaactagaaaggccgggggtggttgcttacacctgtaattccagcactttgggaggcgtaggtgggcacatcacttgaggccaggagttcaagaccaacctgggcaacatggcaaaaccccatctctacaaaaaaatacaaaaaatgagttgagcatggtggtgcatgcctgtagtcccagctactcaggaggctgaggtaggggaatcacctgagcccagcaggtagaagctgcattgaaccaagattgcaccactgcataccagcctgggcgacaaagtgagaccctgtctaaaaaataaaaggaatccagaaaacatcttgcatagaatttgatacaactaaagacatgcttagagggatatttatagttttaaataactgtatcagaaaaaaagggaagataaataaatgacataagcttccaccttaagaaacaagaaaaagactaaactagaagatgaaatccaaagcaagcagaaagaagtaaacaatagggattggagcaaaaattgatgacataaaaaaccagacaaaatacagagaaaaatccatgaaaccaaaagttgggtttgtgcagagatttgtgaaatttacaatcctttagctagactgacacagatcattagaattaggaatgatggagacaacatcactactgaccctatagattggatcaggaatgtcgctgtttgctgcattgtgctttcttgaggggagagctatgaaggaaaacaaagttctcattgcacttacaactcaacaacacagcgttgacattttgattctcactggcttcagtgctcatctctgtgaggtttccagaagatcccgtagcaatatcactcattctaaatttatctttgggctactctgggaacgctgtctatgggttagccctgctctgcaaggagcagtaagaaaatatatatatattttttgaggctgagtctcgctctatcgcccagacgggagtgcagtggcacgatgttggctcactgcaacctccacctccagggttcaagcgattctcctgcctcagcctcccaagtagctgggattacaggcacgtgccaccacacaccgctaatttttgtgtttttgtagagacagggtttcaccatgtgggccaggctggtctcaaactcccaacctcaggtgatctgccctccttggcctcccaaagtgcagggattacaggcatgatccactgtgcctggcaagtatgtttgtagccagtggggaattattttaactaggcaataatttgatctattttgggaagcctcttgtaatcaaatcatatatcaacattaatcacatggtgagtcctccatggttttcattcctagagattctaggatgtttgacatttctctgcttagcttatagcagaaaggtattggatatcaagaatgtttgaacagtttctcctttttgggaatgaagatgaaattgggctagaatgagatgtgtgattgagagaatgtccctgaggcctgagcagtgtgtccttttgggtatgggcattggaagcatgtagtgaattcttataattttatgttgcctcggcatccatcttgagtataagtttaactttgttataccagaagcaaggcttactcacttttgcacagtttccagttctacacctccttctcgttcctcagtgtgattggtccagatagctgccttatccaactgcctcctttggaccacttcatcatgggacagcttgatgcaatctacttgacaagaccctggaaccccacacccctcatggaaccagtgtccacctcccagtcacagtgtgaccccagggaactcttgcctgcttgctttaaacccaccacttaaaagtctccacagaaaacctgtttgaatagtacccttgacccaataagggcattggcccctgggtgtctctctctctctctctctctctctctccctctctctccctctctctctctcgctccctgacctctgcgtgtggactccaggcatgccatatacccctcaggacctgtaagtaatactatctttatttttattttatatctctcctaatcattgaaaaggtgctctctatcttgaagatactatattaaataaaatgagaacttgtccctaacacagttagtgataggctgaaacacgctgattgcactctttacccatttagtgatttttctcaagttactctacaccatgtattatcaacataattgatattacagaatagaattataagacacttcttttgccacagaaagttctattggactcagattatctagagctactacatgtatgctattctatgataaaagatgtagatgtgataaaaacatttataaaatatctgtcttagaaaagttagctaaaattattttgggaaaagtatgtttgaaaatagaatcgtaagctaccacattgtgataaatatttctaaatgtgtctattaacttgtcaggagacaacagagtgaattaaaacagtagccttgtatcagtatgtttttattcagaagacaaatgcacgttttaactattatatgttcttggcttaactttttttgtaaagttaagacattacacttttacatgaatctgtaatttcaagatatcttaatggttgacagggacaggacaattgaagaaaacctgtaaatacatttggtaaaatttatgatggattgttttgcagatggcttcagaggttattagcacatctgtttgagatatgcacagttttacatttgtcccttaggtaatcaacagggctgagatcagtaaatcacatgtaagccactgttatgaggctattctgaatagagttacatcattttatcatatctagactttctagttatattggtgctgttgaaaatgattttgtattacatgctttcttccaaatcatagatcaagatattttatttatgtatgtcttttaaatgaagagtggttaggatagtcctgattattgcacataaatattgcctttcactagattattgttttgggccaaattttagactattattttaaaaaagagtaccttagtttaatccaacctttccagatacttagaaattattgaaatgtatattttgtgaagatggtcttatgaaagttgttgagctagaaacatgtccttcaccagtggaattcttagaagctttccttgggcttcactgggtgctaatagaccatgatcgtattgctctgtatataatggtacaaattttgttttataacactcagtcttaatagaatgggaatattttatcttactaacgtagtcattagctggccactctctgtgtccattggaccttatagggtaaagggagggcagtgcgtatttgaagcctgtgcacgtgacacacaaagggcttagcaacctccgtgttttcccagcacaggatacccattcttcctgaatgtttcattgttaaattagattgtgtgtgtgtgtgtgtgtgtgtgtgtgtattttatattaacatacagatgtatgtattttagttgcattttttttcttaaaatgttattttttctctttttcttttatgtcaggtgatgatagagcccctagggaagcaaaactgtccatgcccttgccttaactttcagatacgataaaaacaacatttataaaatacctgtcttagaaatattagctaaaattatgttggggaaagtatgtttgaaaatagaattgtaagctaccacattgtgataaatattactaaatttgtttattgacttgtcaggaagcaaaagaatgaattaaagaaaactccagagaatgagctgacaacctactccctggtcagtggctctccatgcctacctgtggtctcttggacacccttgcaggtatgtgggcagggaactgcatgtttataggaaacaggcctaggatggaaggagttaatagatcttgctcttcttgagtttgatgacatttgtttccagttaaatagcatgaaaacccatctgagagccagctgagggtggatacagttctggggagttaaagacgagtggtcacaacaggtcttcctcggcaatccgagcccaaaactgaatctgcctccataagaccattatgtgtcagctctttatttatatgattgattcatccagtggacttttaatttcttatgtccagatattttttcagttctttttttcgtgatacaagcaccttgtggattgcctgtcatagaacaggttctcaataaacttttattgaaaaaagatgtataagtagattgtcttgagtaattttgtgaataacctgaccaactaagcagtagaagacaaatgattttaaaacagaaagagacataactttcagtgggattcaggtgatctagtcgggtctggaaatgcgcaagagagaaggtccctgatgcagtgtgctgacattgaaatgtgtagttgtggactagatggttatggtttcagaactgtgtaagtaaggggtagattccaaattaaatcaatattaaagagtagcagagaaggaatttccagattccagctgcattgcttgtttcattggaagtggtgtttctcttttttcttttttttctttcttttttttttttttttttaaacctcagaagatgacttcctgggaactcttctgggagtgaatgttatcagcaaattcccaaaacaacaccccttagacaaaaagcctcctcacctatgcattgcctagaccacccactaaaggtaagatgttagttaaaatagtccttgctttctgggagaagccatgtcttagtagaaattgagctgttaattttccgaatattgatgatgtttgattacattctaattgattctaagatttcataatatgttaagagatgcagcttttcttatataccttcgtggcttttctacatctcagtacatttactgttaatatgaaggatttccataacttctctcatctagtaaactgaactccttcatggcttgatccattgtgatgctagaaaattgttgtacacagaagacacagtagcctctccataactgttagactggaagtttgacaaactggtctgaaataactgatcaaatcaatgaatgacctagagctttaagaaaccagatgggaagagacagacatgaaacccaaggttgttgatggctattacttttgagcccagcaaaaggagaaaaagcagcaccaatatctggcatcctggacatgaggaagttttaatgtcattgttttggcctcatcatggacccaggtgctagaaatgagattttctctgtgtactctgggtatatttgttctagcacaagtagggggaagattaaagaggaatttcatacccccatgactccttaggaaatgtgtttctcacctttgccacttttccccactgtgtccttgcaggtgatggccacaaagaggtggatttgttgagttggtgccattccttctactgccagcttcaccaaaacaatgacacagtcttccttccgcatggagactcttctctttcctgtgttgcagtggatgcctcctgcagataagaaatgcttaactgagaaatgctcatgttgggatatcatcgatgagactttaatttgggcatggtgactgtttcccttgctgccacttgactcaatcccaggagcctcagtagaggatataatattacacaagatgctcaaaatggtggaattgctcagtgctcccataaatatacatttataattttcatttgccacatggtaaactgaaaaatacagactatattaaaaagaaactgcatgattttttttcaaaaattcaaagcatatttaaataatatataaattaaatgccctcctctcttccaattctgtccctatagttttcctctattaagtgaactacatgcattcttttagtggatagatgcacacaaacacacaagccattatggggaaggatccacgtgtgtggccatattgtaacacatttttctgcaaatcacctctttcatttaacagcccttattcaatggcctttttctttttcagtagtacatacacatctgtgtcatttgttgaatgacgacatgaatgttttgtagataaaatataattaaatgttttaagcatttctcactcatagatatttatgttagcaccaaatttctgtgcaatgaacctccctatatatcagtaattttgcatttgtctataatatcataataaattacttatcagttgaattactgggattaagtatgtgcacactttatatttatattttgaaaattattgcaagattgccttcaaaaatgtggttaacaactttatcttcaaatggcaatgaatgagattgccagctttcctacagcctcacagacaatggattttataaatatttaacatttttgccaatgtgatcacccaaactattgtcttaaattgtatctcttttgtttttgagtttggtcattttttcatgtttattagccatctgtattttttaatttcttctttatgtccaattttgtgggtgggaggaggatttagtctcttcctgatttcgaagagctcatttactatttcgggaaataagatttggattgtcaaccattatagctattttttacacacttttcaactttgtttttgttataagaatgtgtatgattgttacatgtccaagtataaccatgttcgcttttatggcttctgagtttcatgtcatttttggaaagatatatatattgagtccataaaacccttcacctatgttaaattctaattcttttgtgtttttttaattcaaattcttaaatcatgagaaatttttttgttttgaaatcttaaagttgccaagttacttgccattacttgcgattatttgccaataattgcccatttatctgtaccgccatcttgcgcatatgctgtactctcatctgtgactggctccatttttgttctgtggatttgtgtgtctcttcttctgcctcctgtctcgtgtctgctcgttggaagaaattacagtttagactgcaatttcatcaactttaataaatcaattgaggggagaattggtttttaaaaatattaagtaagtcttcgtatccaaggacaaggtatgtcttttcttattcaataattttaattactgttaatattttcactgtggtgatgggagtttttcttttaatttattttcttgttcattttttgtatctaaagtttttgttttgttttgttttgggggtaagttgtcaccttactgtttcttgttgcttttcagattttttcaaagtatagactaaatccttcacaaatatttaaagtttttattttcccccttcatattgatcctgattttagttatgttgacaaagtccacagactgttactatcagaacacttgaacagttatggaaatattacctacccttgatttaatcagagtttaatggtatgcttctttggtttgactggcacattgtcgctggtcatttcctcccaaagaccaccagaaagagctatgatcaagcaaagctgagtttgttaaacttacctgcagcaagggaaaacaccaccttgatagggtttaataatgtttcaaaatcaagaaatgaggctttggggtctgggcagggaactaattagaaatgggcaaaatttgtcatgcaataccttgtgggaaagtgagatgaggttcttaatgtgagtattgatggtgaaatcattttctaggtgagctgtttgcctatataaagatgttatcaatgacagaagaactatttgcctagataaacaaactgaatttatttattggtttacagttttatcttgctgggcaggactctgctgggggtggtatcaggtcttattcccaataggtaagttatttggatatgggtggtcttaatcatcaatgtgtaaaatgctgattttaagtgcgaaatactttgtctaccatgttaggaaagtctgccaccttttatcttttttaaggaattttaatcaaaaccaggtggtagatataatcaaattgttttgcagaatcaattttcctgttctctttaaagacttttatcactgtgaattaatttactattattgcaacttcctttaattccttgaatgaacagaccctactggttttaaaaatgttttattcttttaatttactacttaattgtgggtattttaatttgatttggaatttttacaagtatacaactaagtgaaattgatctgtgatttttcttttttgtgctatttttgtcatgttttgatatcagatattctggttgtgttaaaataattttgaggattttcttcttatactgtgttctagagtgggtaaaaaagccctagtctcactatcagtgtttaagtgaacacatcagtgacatcatctggactctcctttgtttttgctggtttggagttaggacatctagaagtttttttctttttttcctttttttgtatggttattgcttgttctttgttttgtgtcaaatttaacctgttttctcttagcaaatcacagctcatgcagattttcaaacacattagccttgttatacaaagtgttctttcatcattctattaaatttccattttcattccagttatagttatttctgctgtgcctttgttaatgaataagtttaaacagtggatgtttagcatcactagccttccccttccatctcccttaatcaggaccttggtataatttatcaggtattttttaaggttctaatttacttatatatattgtttctgtattcttttgtttcttttcttaataaattcttaaacctgtgtaacacattcatattcacttgttcttggcaatgaaagatttaccctgctgtgcattttataaaacttgtcattatgaacacattgtaaacatacagtgtatgaagagaagaaaacagtgaactagcacatacaaggaactggaactggttccatcattatcagtattttgccatatttactttgtgtttattttaagtattttcaaataagctagagaaatcttaacgcttcttattctcccataaacatttttacaattttatttttgaatgtgtatgtatacacattcgtatgcttttatattgttctataactttcttttatatcatgtaatatataaatattttaatatttctatctgattattacatatccatagatgtgaagcttccctatttttaataacttatatttttacataagtaaaatttacatagttaaatgcattgatatatagtaattgtataattcaataagtttcttaaaagtaattactatcccattcaggagatagaatatttttattacttgagaacctaccctattgcctctttccaaccaagcaccttctcaaaaaaacaatgttgtgatttttatgatcatagataagttttgcctgtttggaaattaatataaatggaatcacacagtgtgtgtctggcttcttgcactcatcataatcatgttgagatttatctgtgctattccctatatcagcagtttaaaaaagtttctatagttgtaatatttcactaaatggttatattgcagtttatctattctcttgttgacggacacctgagtagtttctagtttttagctgttttgaatgttagcagatctcttatgtaaatacctaaaaattgaattgtttgatcataagacagattttgcttaacttataggaaactgctagagagtcttctaaagagatggacacttttcgcactcccaaccagtgatatgagatttttagttgctgtccatttttgccaacattggaaattgtcagtcttatctattaagtgggtgtgaggtgatattttgttgtgacttcaatttgaaatttgaccacttaagaaggcaaccagtttttcatgaagttatccaattgtaaatcttctttagtaaaatttgtatatttttcccaacttttaaattacaattttgaagtaattttggacttacgggaaatttgcaaaaatagtagagttcctgtgtattctgtacccagctttctggatgttagcattttatataatcattattataacattattacatacaatgataattgaaatcaggaaattaatataatactgtcaaccaatctgcagactatattcaggtttttcaagttatgctactaatgtcctttttatctagtccaggatccaattcaagatctcttattttatctggcatgtttcctttgccctctctcctgactacaaatctgggagagctccctcagtctttctttgtatttcatttaattgacacatttgagaaatactagaccataatttggtacactagtcctcaatttggatttgtccgatatttttattattagattaaggttatgcacttttgacaaaagataacacagtagtaacagtgtgcccttttcagtggatcatctggagtacatgaagttaatgtcttatttctgctgatactaaatatgacgcctttattaaggtagtgtctgccaggtttatccactgcaaagttactgttttcctttctttgtaattaatattttatgagaaaataatttgagactatgcaaatattttatttcatctaatttcagtattaattgaagattcttgcctgcagcaattatgattatggtgtttacctagtaatggtttctatttccatgatactttctctacttactagaatttgactgtaaggaagatctgtccttcttccccatttatttgtactcagttgttattttacatcagtatggatttgtggatatcttattttatggattgttatatattgcaatcattgtttgtgtttgattttcaattttttttctggatttgatcattgggagctccttaaagttggcccctgtgttcttttaatacaacctcataattttttgaccacttcttattttcgggtatcacaagatattctaggtttatcttgtattttccttccccacgcctgtaatcaaccatttcctcaaggggttctagttcttcatattggaaaatagtatttagaaaccaagatcttggtattaagtgtattaattgctaatggggttttattgcttctaggcctagagctgggagctgtgtgtccgtttacacacatacacatacacacacacccctatattgtctctattcatttatctatcttaaatatatatactaatagtatgtagaatactatagatagtatatatctatctttattaaaaatcacaagttcatactgttgtggatcataatccatcatcatatggttcattttattcttccctcttggcttatttgtgatttgcttcttcaacagtgagaaacctacctttcattatctacaatatgttttgttatttcttcagtgcagtatacacttaaataatttcagaattgctaaattatacccctttaaaaatgaaatcactaactacagcacagtatttaaatatagttcttttgtctttatccttaacagcgttcagtcaacatactattatttctaaacgtatttaggttagttatcttttttttcctatcccctgccatatggttacattaatcatataatcaagcaggtttttttattgtttatattccattttgagttccctcaccttttggattattttaactatattttgtatatgtgaaatattactatgtttctaaaaattaggactgtgagaaataccactctcccatcatccctgctacactgattctattcctcccttctttccaccctaatctcacccaacccttagagttaactagtctaatagtttctggtttatttttttctcttgttattcttgttcacaagtgggcagatacatgtatattttatcatatatcacatgtatattttatatccccttccttcttacatgattagtggcatactatagatttttttttgttgcagttttctttttccgcttaatatgtcctggaaatcacttcatgtgtattcaaagagatattcctcattctgtcatgcttagtgcttaactccatggatgcaccacaatttattcaacccctctgctctatgagaattgtttgcaatatgtgtaaagtatcacactacaaatagttttacattggattgtttatttgctcttcgtttggaagtgttctttgtattactgggacatacatttcttgttcaatatatgtgttgcaaaggtttctttcattaagtatcttagcctgcctgccttcctttccatttcctttctttttcttttctttcttctccttttaatgctgttatgctctaaattttaaaatggcccgaatttgccagtggctcatcccttattgctatttattcttcctctccttttctcccccatctcttttcctttaatttacgtgaaattaacataacgtagccatttagtgcattcaaaatgttttgcaactgccatccttaactagttccaaaacattttcagcaccccaaagacaacccatacccattaagcagtcagtcccaactctctttccccatcttttcatttttgttttttggagtttttttgagacaaagtctcactttgcacccaggctggagtgcaatggcacaatcatagctcactgcagcctcaaattcctgggcttatgcaatacttccaccttagcctcccgagcagctaggactacaggcatatgtcaccacaccaggctaatttataaaaaaaattttttagacacagagtcttgcagtgttgcccaggcttcttgtgtctttcgataaacagacattgaaaatttttaagtccagtatatcagtttgagtctcttatttttagtgcttattacttactattaaatctttgcttactccaggtttgcaaataatagttttctaagttttcttctagaagctttgggacataagtataacatctatctcaaatcattttcaaatgtagttgaagttacttgttttcatcaatctccagttgttgcagaaccatttgatcaaaagatttttctttttctactgaattatctaatgccattgttgaaaataagttggccatttacgtatggatcttttttgaactctctgtttttccttctttatgccattctttttcactgaagtttaatagtaaatcttgagattaagtagtgtgagtccaaaattttgttatttcaaggctttatagaggaaggagatggctacactgggtcctttgtatgttcacttaaattttaaaattatcttgtcaatttcctaaaaagcccaaccgagaaattgattttgattacatcaaaactatagataaatttaggggggattgacatcttaacaatgttgagtctgtagttctccatttattaggtcgtctataatttctcatagatgtcttttatggtgtttagtatagaagcataccttgtagttttcaatatagaaacattattaaaatttaacatttaataaactagattaaattgttaaatttatttgttttgttgttttgatgctattgtaaatgaatatgtttaaatttcgttttccagatttgttactattatatgaaaacagtaatattttcacattgcaactgcttttcagttgggttgtcttcttttcagtcttaggagaaaatatgtaatttcttaccattaagaaagatactagctgttatttttttgtagatgcccattaccaaattgagcaagttttattctagtgccagtttgctgttaatttttataataataatgtgataaatttgctgaatgtttttctacatttattaatataatcatgttttcccccttattctcttattatgggagactgcattggtcagcttttgaatgttagcccaacattgcattcttgatgtaatccaattggtcactgttatccttcttgtatatatattactgtattcaatttttctgctagttatttaagagttattcacctatgtccgtgatggccattatcctgtggtttcctttttaaaaattatttttgtcagatgttggcattaggcttcataaaatgtatttagtatagtgctctatttgctagtacacttgacccttgaacaacagacatggagattaggggttcagactcccccatagttgacaatctgtggacaattgtttgctctccagaaacttaactacgaatagcctactgttgactgaaagccttacagataacataactagtcaattaacacatattttatgttatatgtattacatactattttattaacaataaagtgaatgagagataaaatgttattacgagacataaggaagagaaaatatatttactattcgttacgtgaaagtagatgatcataaaggtcttcattctcatttttatgttgaataggctgaggaggaggaagaagaggaggggttgttcttactgtatcggggtggcagaagcagtacacttggtgtaactgtatggaaatatagtttctagcttttttgatttttcatttctctaaaaatgtttctatatggtacagtccttcttccactgtttacttatttgtagtacccacatcatagaaggagccatattgtaaagaagtcaaatgcagacttaaataattagaaaccttctgccagcgtgtttttctggcactccttctgtgtcgtcttccttatcgtctggtactggttcagaagcacttgtctccatcacgtcatcttctgttaattcctctagtgtgttatctattagctcttgaatttctccaaggtgtatatcttgaaagccttcactcaccacccttttttccgtgttcacgatctctttcgtgatttccttggttggctgtattgtaaatcctgtcaagtcatgcacaacatctggacacagtttcctccagcaggggagtgtgttgtgttgggcttgatgctttcacagctttttgtgtaacgatggcatcttcagtgctgtgatccttccagactttcatgatgttctatcagggttctcttgcatagtgttagataatcctttccataaagtactgtgtgtaatgagccttaatggtccttatgactccctgatctagaggatgatttagagatgttatgtctgggggcaaatagaccactttgacaccttcagtattgaactcatggggtcagggacattgtccaatcaaaaaaaaaaactttaaaaggcactcacttactgcaaggtacttcttgacatcagggtcaaaacatcaatgaaaccaatacagaaaaaaagacttcttattgtccaggcctttttgttttacaatcaaaagaccggcagctggtgttttaacttttcccttcgaggctcaggagttagctgctttatagataaggtcagtcctgatcataaacccaattacatttgcacaaaacagtagaattagcccatcccttcctgccttaaatcctggtgctcacttctcttccttactaataaatgtcctttctggcattttttttttttcagagtagggcactttcgtcagtttaaaaacctgttcaggcagatatcctttctcctcaatgattttcttaatggcatctgggaactgcttctcctgcttgactgtttttaagccagacttctttctaaaattatcaaaccatcctttgctggcattaaattctccagatttagaaccttcaccttccttttgcttaggatcatcttgcaccctagaggtatgccttacagcaatcctgtacccgcagaaaagatgcattttcaatagatagatactttgcaaaagtgcaaggttttcacagtgttggtacagctgcaacaatggcttcatgaatttccttttttttttttttttttttaacaattgtcctcacactggatttacttatcttgaaatggcaagtagcccctgctggagacctcaatctgtggtaccttttaagcaattaaacgttttcttgtaatgtcatgactttcctctgcttcttaggagtacttccagtatcaccagtggcacttcatatgggtcccatggtgttaaggtttatggtattacacaagacactatgaaaagtaatatgagaactgtgaaagcttttgttttgctgccacatgcaatttactggagggagaaactgtttcctggcatgatttcgggtcacctggcactttaagcagatgcaattgagctccccactgtagcaaaaggaggtggctacaaaattattacaataatgctgggtgtactacagctaattttatgcagttaggatttaataccacatatttacatttctctcaactgcaaatggcaccatgtaggatctgtgagtatgtgtgagtaggttttgataaattttaactttttataatttgtgtatattttatggtaataaatgataaaaataggctagtatctacatctattttatgcattcatgacatacctttttcttaatttttttggtatttctggactacgcagttgagttttttcaaattgtcacaaatttccaaaaatgtatccaatgtatttattgaaaaaagtctgcatataaatagatcatatgcagttcaaacttgtgctgttcaaaggtcaaatttctttgtggaatgtttgatagaattcattagtgaaatgatctgggcctggagtttccttcgtgatattttaatgaacaatttcagtttatttaataatacaggattgagagtttctgtttcatttaatggcagctttagtactgtttttcaaagagtatagtccattttatcagatttgtcaaattcagtagtataaagttgctcatgatagttccttattacccttatactgtctgtaagatctcacctttccaattctgatataggtaatattattttttctcaggttggtctttttttttttttttttttttaactatcttgtcatttaaaagaatcaatctttgatttgctaattttctctttatctgttttttatattattgatttctttccttcatcttaccttggttttaatatgctcttttttttggtagcttcttaatcttgagactattaagtcttctattatgtaccttacttattttctaatataaccattgaaggctataagcactacattgatagattccacaaactttgatatattgttttaattaccatttaattcaattattttcttcctttgtgttttaatttgatctgttatttttaagtggagtatttaatttccaaatatttggggcttttctgtgtagtttgttacaacttctgttttagttttgttttggttctaaaaagttactctgatatttcagctttccaaatttattgagacttatggtctagcatatgatctgtcttgacaaaagtttcacatgcacaggaatatatatttaaactcaaggtgtgcagattttgttcagatagatagtgtctagattttctagattgtcagtgaatttttacaattgttttataagttacaaagagaatagtgtaaaaaatttctgctgtgattatgattttctttatctttagttctctcagttcttcgtgtatttggaaatatcttattgtttatacttttatgaacatcatgactgtaataaattttatcttttcctaatttggcctgtcttaccttatgtaatatttctggtcttgatgtctgcttcgtctgatatctgaataatattaccagttttcttgggtttgcagtatgtctggtgtatctttttctgttctttaaatctgtcttcatagtgcttccattatagagagcatagagatggatcttttttgtccaatttaaccatcagtgacttttaagtctttggggtcttaagtccctttgcattaaacatactaacgtgactagacttatgcctactatttagctattgtttttccatttgtcccctctagtttgttcctctctgcctgctttgcttcgttcttttgggttaattgaatatttttagtatcctacattaacttctctgtttacatttcggctccacctctgggtattttgtatgggttataaaatgtacccttaatttatgacaatctgcttagagttagtattgtacacttctcatgaagtaaaattttatatatatatatatatatatatatatatatatatatatatatatatatatatatgagggagtctcaatctgtcacccagactggagtgcgggggcatgatctcagctcactgcaacattaggtggaactgtattaactctaaaaggactgtgataatttaaagatgtatattataaccatagaataatcactaaaaagtacagagaaatatagctaaaaaagcaacagcagaattaaaatgtaatagtaaaaatacttgattaaaagaatacaggaaagaatgaagaaaagaacaaagtaaactgtatagaaaacagatggcaaaatggtagacctaaacacagtcatattataaattactttaacggtacacttgtttttcattgctttaattgatcaaatgataggtaaagtattttaaagtctctttgtagttttctttaaatcttaacattttgtgcaatgtttgctttgtgaagattgatgctatgatatttaccaatcatttagaagagatattgctgggtgttttggtaagtttaggttacttacatatcttatatgatgaaatcaacattttttatttgatcaacttaatagaggcatcctgtttgaaagaagaaaataacagatctacaaaattctgattcatgtaataagtaaccattatgataataaatgtttttatttattgagtgcatactgaaaagtggtaggaagattttgtgctgaaatatttgtaaacctagtaattaaaaaatgttttggctgggcttgttggctcacgcctgtaatcccagctctttgggaggccgaggggggtggatcacttgaggtcaggagttcgagttcgagaccagcctggccaatatggtgaaaccctgtctctactaaaaatataaaaattagccaggcatggtggtgcacgcctgtagtcccagctactcgggaggctgagatgggagagtcgcttgaacccaggaagcagaggttgccgtgagtcaagattacaccattgcactccagcctgggtgtcgcagtgagactctgcctcaaaaaaaaaaaaaaaaaaaaagctgctaattaccccatgctaaatgtgttgtaatggtattaatttgatatataacatatatgtaacattttatatatgtgctcatatgatgatactgataatacctccctcaaattgctcttttgagtattaagaaaagtttatatagaaaaaccagtttggaaaggtttggaacataaggctacagtgattagatgttgagaacagcagcaataatagttgtcattataatatctgattaaggcaatatttgcacccaggtataccttgcttcagaactgtgtgattaaccattataccttgaggctattcataccctaccttcactttgttggcataatctgaagttttaaaccataatcacatattgcatttgcacaattaaattttaaaatatatacaaattacagtcaaattattgcattcatttcatgactatattctgtttccatccataagtaccgtatggtcaacaataacatgtcaaagagaattttgttgtcacctcgtttcattgtaccatgttcacactgttctttatctcttttttccattggcagtattgtgttctcaagaagaattattccagaagcacccctgaaataatatatttccttaattttggtattattagcccttctttgcttttctctataaattgtcctgatcagtcacctctctcaattatatacaacacaaagtagcttaaaggagaaaaaaaaggagataaataaccatgttgggtctggcgtcaggcttaatggagtccagtagtccagaatttaaagacacatatgaccgtttgctcccttatctcttagttctccatttcttggtttggcttaaatcttcagtcactttttctttatgtgaatttgcaaagggatcatttgaagccctagatgcaattattacctgccttgcaatcttggtaggatgtgtcctccttccctcctccttgtccatgtaaaagttggtgggtgaagagatggacaaggcttgagtcactaagacattcactgacctgggaataactcaggataggtctggtcatatccccaatggaggcaatgtaccctaatgaaaaggtcagggtcactggtctcattgtccaaggtgttatctgagctcatggtctcacaaccaagaaaattaaggagtatggacacagggtgaggttggttggagcaaaagtttagtaagcgaaagaagaaagctctctgcagcagagaggggagtccaagtggattgccgtttttacagtcattcaaaagcttttttaagaaactcctctcatctctgtagcactttgagtaacttctcttatcagcaaagctgtctgtacaactccccttatcttatgcagctgtgggtatgtctctaggcaagcacaaagcgccgcttatttttgtttgtgtaactgagggtttgttttaggtaagccccctcctttctgtgcaggcttccagggagcccaccatgtacatatctgaaaagggaaggaaactttttgctgggagcttgttaatcatacaaagaataaagggcttccatgccagactttgcctgcctgcttatctatggcttatctgtgcagctatagcctgagtttcccctggctgctctgtttttgcctgtagctgtgattttttcaggcagacagcttctctgaggactagtctcttagctgtttactcaagtaatttttcctgtccttttccctcactatgattaccagctcccctaggacttcatggtctggaatgaaatattccgtgggagtcagggaaagggagtttgttgcaaacatgtccaggccagacactttatataaagtgtcaaagtaaagtacacttacataaagtgtaagtgctgccaccaccactagggtgccaggtactctaacacaagtctttattcccatagatgtgagttaacatttataccaccagctcacactatcaaacaatcccacgtaccccaaataaacactggtgcctggtgggcagcaacaagccctccttcaaggaaggagttcatttgttggtttatccagctgctcccgctttgcttatggaagcgctccgttttctaggggtcttagaagctgtagcagtggtagaaagccccttttttgtggactattatgacttaggcttttatcagagcctcagagaattgctgttgttttgttggttaggctttaggtttccaatctgcatacacaattcctttgaagcaccaggcttccaggcaatttggttgagggaacttattgggatatgaaatattatcaggcaccatttctaatcaatgtacctaagttatgacttcaggtttagagaaaaaaaaaatttttttcccttggcttcaggcttccttctggaggtgataacctcctaaatggactgtctttaagggcctgtggcatgtgccctcctttcaggaaactagtgtatgcctggaggcattggtaatggcttctctcatcttactgtggcttgggaagaatatggctattgcagattttctagtttcattaccacctgaccttcaggctccttacatgttataggcagaaaaggtgcctccacaaagttgtgggctattctctgctttcagaaggacagctggaaatggtacttaattctttgtagcagcaccatcatgaatagctgcccacacccatatacatcattatcttttttggtgaagactctaagacttcaggccatgatatccacaaggctatgttcatgcactacttcggtataatctcaaaataattgccagctccccagtggaacgcctgccttggtccatgtggaatgtgggcatatggtaggatttccttggaggaactagaagaggaacataaagaatgttaggcatataaattattgtttctttttcttcttgtttctttccactgagttatgtgtgagcccccacacccaccctaccttcctgtcctctaccttactgatgctattttcaggctgttgtagaattgggtgtgtaaaattaaattagcctttctcctcttaatatctgtaaaatgaacaaatttgacaaagaaactacctatctgatatataagaaggttattagcctgtaccacaagtgaaaaagtttcatcctgatatatcaaaatagtaccacttgaaggaaaacgttggggccatctgtttctctcattgtagttagagtacagatttttaaaatatgagcctcaggcataaaaatgcagtattagcaactcaacttgaagaagcagttactagtgtcctgggtgggccccagggaaaatagtaccaactgcctgttatatttaactgcaattaaaaatggcagtgctgggtatcttctgtctctgggtcatctcctaaagatcctgcagagggagccatagctagtgtagaggccagccataactagccatggcaaagaccacagggaacgctcttcaacatgctctgcactgatcctctaccctggtgtggagaaatgtcagattcatcactaacaaggttaaaggtgtaaattgagggaaaaaaatgagaaaagttatctttcacataagacttcagaaagaaattgcgtcgtcaggtttggaactggtttgtaatttcatccagttattttcattttaattactgtcactgttttcttcatccttgataaactatgagctctttgagattgtctttttcatatcctgatgtcagagcttcctgtattttctgatcatggtatgtgctaagtaaatgcaatttttagcattttgaatggtttatcaaatgattgaaggagtgggtaataatatagattacatatacagtcagccacatatgtgtatgtatgtgtatttgtgtgtgtgtgtgtatatgtatatactgttgaccctccgtatcaatgggtttcacatttgtggattcatccaatcatggatcaaaaatattctttaaaaatatggttgcatctgtactgaacaggcacaaactttttttcttatcattattccctaaacaatgcagtatgacaactatttatcatagcattgacactgcattagatatgataagtaatctagagattaaagtatataggaggatgcatgtggatcatatgcaaataatacactacatcttatataagggacttgaacatccatggagtttggtatgtggtgggtgatacctcctctttgaggaggtgagtatcagagacgcaggtaaatatgatccagagggcaaagaggcattgccagcctcacactggctgtcaacaccatgctgagttccacgaaagcagcgaggagagggtggtgttcttgtttctggtacaatacctggcatagagaagatgtcacagcaatgttcgtctattgaataagtcaccaaaattgtgaatgactgaataaatgggcaaagggatttgttccctacttgctgtgggaagtttcttgtagttatgacctccatgaaagagagactcgtatctggagaaagttcatagctgaaaccatgagatttaacttttgaagttataatggatctatttttttaacatcataaatgaagattatgcaatactgtatgtgcttcaattgacacaaccccttcccattcagggctgatttatgttctgtactgaatgacaggcacagaagtaaatgtgataatcctgtcccgtcgttaccctttattgtggtcttgctgtgtcccagccacacacttcatactgtatctgtgtcatcattctcatatacatctatataggtacacttccatagacttaggcccatttaatggaggagcaactccaacatttagagatcatgaaaggtacctcatgacatatattgacctagtggcagagctgcttagttctacagcctctgagtggaatcctcacgacagtaaaaacacaagcttggtttctcacacactctacctgctttttctcatcccctttagtctctattccttgctgagatgtgttaggcattaaatggttacagtctacttctgtgtgtagtctccaaacactcagaaacctcaaaatttaaaaaaatacagaacaatatgttattaaataatcagggacaagttaaaatggtaaagagaataggccactttgtgaaatcatatgcagggaagaaaaaaatactggagtgaaaacaatataaaaataatactagatgctgtttcgtagcaccaagtgtgttctagcttctgtggttgttgctttatatcattttatataatctttacacaaaacctacaagcagatattatttcccctatttcaaaaatgagaaaaccaaggcaaatagttggtaagtagtacatatatattatcctaactctgaacttctggattcaaagaccatgttctaggataccattttgtgtaccagcatggaatatgtttttagttcatctatttactctaaaaatgtggagcatgtagtgtgagacagaactgttctaggctgtgaggaagtagctgtgaggatggtagtatgggtccctgtaataatgaaaatggaatatattggtatgtacaagtacatgctcattaaaggaaattgatgttggcatagattgcctgggttcaaattcccatttaccatgttttcctagttgtctctgtggtgagaggaggtggaatgtactagccattaccaaaattaagagagattgttggaaaaagtctcatttagcacaataacacattaaatgtattcaataaatgttacttatgactctttgagaaaacatacgtttaaaaaacatggcttatgttacacatactatatgctggctcccaaaaataaacatatttcccaagaagtgtctgttgataaagccaaatatattcttactacactaaggggaagcccatcttagcagtgtctcagcagcatattaggggcgtgggggacaaaacaggatatctgggatcttgaagtttcattttagatgggtctttcagtgtgggagcttgattaggattgggtgagggtcatgacacagcattttaagattgaacgttaggattttgagatgagggattctacagtgtggaggcataagctgtggtctgatgctttctgttgatgagttgatggtctttgggaagttcccaggatgaacaaaaatatttgcaacttttatcttcctgggcaagagtctcagaacatctacacttatatcaatgaaggtaaaatgataataatgtccccagcgaagacaggaagccatgtgggtagataatgtaagttgtgtcatttcatggttccatggataagcagctgtacttaagctgcttatcctggtggattctggagatccacacttgaaggtatcaacacagaaatatactaagaggattgtggtcagagtttgttgtcagctactgagtgaggagccaggaacatacagcttttaccaagaaaatctataccatccacactgtgatgagcccacaagaccagatatgggactttagccaaattacctaattttattatgtctttgattgctttctggtccttatctgggatatcagagatcccagagagatggcagggatgcaaattaaacattcttcccccaaaaacaacacatttttcccttataaaattactatattctgaaaaatttcatgaacctccaagtcaagatggggcattgtctaacttgcctgctgtttgctatacaatagcatggagtcagctccaggcttcccaaccctttcgaaaagcatgaattgaagaggcttaaggagagaagaaagcaacccagaattccctgtgtggttacagtttgggttcttgcctcaaggcctggtttttctctttttggagtaaagttatctgaagacctctttttctaagagaagaaactaatgggtcaaaatggaccctgggggatgtcagggactacagtgaaggcagacgttagttcacccctgaaataaatttctgtccagtgtgcagacagtagccagcagacctttgtctccatcatccaataccagtcttttcagatctagtcaatgatctatttaaagccaaaatatccttatgagactgtcaaatagtattgtatttttttgtatcactcgtcaagaatagcttagtacccggcaataaattttatagtactgatattaatagatctcaggtgaaagaaaagtcatgtgtcttataagatgggtgaaagccacctccaaatagatactctgttctctagttgtttttcatgttctattcctctgtaagttcagttacaaaagctgacttccacaaaaagttctccagtattgttttggaaccttattttctaatatcttgtcatatacgagttgagtcccaattaatgattcattatgaggaactggaaacgagaaactgagtggctcaccaaggaaaatatgtgcaaacctaacggacaatttggttatatgatttaaccactgcatgcataaattataactaggtattggactcatactgaggagtgattaaaatgtaactatgccttataagcaacataattaaatgtagctttaagccagataggcaagaaaataacaaaaggacgcagattaaaacatgacaatatatggtattgttctatgagtcttgagtggaaactctacatttcatgcagtcatctacttgggctaaaaatcatgtgtagtggccatctccttccaaagaccatcttacttctaatgagttctcattgaggtctcacgttctcagtctgaggtctccaggtctcaagatttctcagcttgaggtctccagtaatgatttaagatggtttatgcctctttgattggaagacatcactctcagtatcaactccctggaattttacttctggatgagtcgttaacagtatccgatagggtcttttccatcagggttcgagggctttctttctcaggtatctctcctggagatacctgagaccaagcctctgaatttagaccatgtgagggtcatttagtagaggaaaagctgcttgtttacctcttaataagactggataaattgcctgagttacctgcaatatttggctgtgatcacttccaataatgtagagtctagaagcagaggagatattcctagactcgtgggttggcctgttgctaactcaaaagggaagatttgatgaaccccagaagttgagctcattgtcattaaagcaaacattaggccatgtgagtttgagagtctttgatagttttgctaatttgagcttaaactttttgtttattctttctatatttcctgaagattagagtaatatggacagcagcgtttctgtgtggactggcagagctgtacaaagctctttatcatctcagtaaaatggagatagtttatacttgtactagagagagagtttgggaacataaaatcatgtcaaattttgctctggcagagctggaaatctccaaacaaggcctcaatctatcctccaaataagcgaacaattaccatacatactcaaaacccattgcagaaggtacttacaaaatctgtaagtgttctaaggggccctgagattcttgttcatgccccatctttgcatttttaccaagattatactggtaacaaataagacaccgcatgcaacctcaataatcttagtgaaatttctccatcaatgttgattgagtgcagtagccaatttttctttgcttaggtagttaattgcatattaaatgtttgaaacatcccgtttaaggtcctctggcgctactaagcatctatcctagagtgtgagagattttcctcttgcaatttacctgcagatttatattagtaacggtttgccaactgtggaaccaattgttgacattctataagaacctgtttgaacccgtcagaaggtttgattatgaggaccaggatcttagtgagggctccatgctggggcctcctggtatccccatcttgtattagtgtttgtttttttaatagccacatctttagcaagctttacaatactcaaaagttcttttatttgctgaccatttttagtagaggctcctgctgagattgagaactctgtttgttcacaaacaagaccaagaactacacacaaagcatacctgccaccagcactctcctatctcactcaaactgaccagatctgtagagcgaaatgagtcctgtcatctggcagattttgcctctggtagtgattataagggtgaagtatgtcacatcatgtgccatctgatattcttttgtcccagtcttaaagtacagcacatcaaagaacaagatgaaacatggatttttaaaaagagattactaatacatctatttagggcatagtttgtaaacaaagacagtacacagcttcttcttaaggtaatggaaaaagtagcaattttgaaagtattgccataagtaataaagatgtgaggtgctgatgtgaagtaatatttcataggaatttaagcctctatgctgaaaagtatgtattttcaattttgtgtattttcagtaaaggttatccagcaagagggactatgaaacttaaaggagaccctaacctaaaccaagccagcagaggcttccagtaatttagctgttgtggctattgccactgggtgaagatacagacttcaatgagctggcccctgaggattctcctgaaatgcatttagaacaccaagagcttatccccagcactcatatacaaactggtagagagttctgtgataattaggtaggcctaaagtgggaggtcattggaaggctaattttaactcacaaaaatctctttgtgattaggttcttagggctcagttttggctactcataaagtgggtaagtcagagagatgggaaattttggaaaattttggaatgttctgcaataagcatccaaggaaacccaggaatcctcttaatgatctcttaactactagcctgaaaagttttggatagcttataatctatcaggcataaaggattcatcttcttgggataaatcacatcataggtaacgaacttaaacaaaattctaacttctctttggaaattgtatgacctttctgagctaaaacaaagtagataggtagaataagtcttagaacttgctttgtctttagaacacagtcactggtcattcatattatctattgataagagtggaatcacagaaatttagggtccttgaaatcgttgtgaaaagtaggaaggtatctaagtaaatccaggggatatagtacaagtatgctgttgattttgcctagggtgtaccaacaagtatagagtattttaatacaaaggcactataacaaaaaagtagaacacaaatctgccactataagatatgcagcctcaaggactcagtggaaataagatggtatttgggtggggtatgataaacagcgattattctatttatggttctgaagtcctgaaaaaatctgctatctctgccactgggtttttgagcatggagtgtaaaagaattataagggctgttacaaagtttttagctattattttagtcctttagtcctttttaatctcttggttttagaagagattgtgcaagttgggtagcagttaaggtggataaatctgagtcttaaccgggtttatccataagaatgtcaagcacttccttgagatcttcaattttggcttgatttagattcaatagtagtcgtgaatcaatgtccagattatctatggtttctttatgagtgagggagtcagagactcaaggtctagaccatccagatagcatttaatttacagttccacccacgtagtaacttcctacctatcatgtgagtgaatatggtattacagagaaagaaagagtgtaatttagttaaagtccaagggtggctgtaatgggctgggatgtgaggaatatttgataattattgcagaaacctaccatgtgagtagtttattttcaatgaagaggttgtgtaatagtgataaggtttaaggttgatgatatttagcacccatatcagttaaaaaaatttgcagagttgtcatttaatatttagagaaagttttctttttgacttgaaagatgaaatgttttgtgcttgatacccaccggaagcaccttgatttgtcacttatttcatgttttgccctttgattctgagctaatgcaaaacaagtgttttccaatttccttactgcttacaggcgtctttatcaagagacttccttattccgggtttaatgtctgggataggaggatgtaattttatctctactttgattttttttaatgaaactctttcaaaatgtttagtgaggtgctagagatctgataatgggaataatattgctcattgtagtttttttttacatattaaatcctgtttttttggcttcagttcctttctgcaaaatggggaaagatgtgtgtgggctcatatctgcttcaaggtctactgagtccttcctaagggtattaaagagcctatcttcaatttctccaatggacacatcctttctttgcttgcaggactggattataaaacaatctattttcacagggaagactttaggggtagtctccaaaagaccttgtccaatatcttcagtttttctaaaattctttgtttcctgtaaaatttgaaactctttggtttcctgtggtcttttatgtcaccactgagactgacccattttgcctttttcatgtacttttttgcatctagggttatcactaaaatatgaactccttggtatagatttgggagccctggattctaacttcctaaagatgttttataatcctcgcaagttttcctctattctgcctgtgctttgaagagcctttgacggggtctctcatctcagagttagatggcttaaaatcaaccacagatgtttccctgttgtgagggtagtttaacatgaagaggtcattgagctttggggttttctggctgtctgaaagagaagaaaaattgttcagagggagagatgggggagagaataataataggataaagtctatttggtttgagttatgatttgttggtatctaaaacagagagagagttttttttttcttttgccctggctaacaaatttcataagaaagcagttttgaaatctgaattgcctttggatgtttctcagattaattaaaaatgtagactactggatgtttgaaattttgatctatttttattttaatgtactcttaaaaaattttgttcatagaaaaacttcccccaaagtggctgctataattgtaactcatctctgttgaaattatgccatttaaataagtatatgaatgtggattatcttataaacatatggaagaagaagtccagagggcgtttggaattagaatgagactggaggcataccctgaaagtgtggtaaaactctgaaaaaaatgttgcttatgaccccttgggtctctcaacctgatttctacattgtctaactgtagacctgaaggaatttgcagtttcttgggggtacataagatgttaataggggatttctcttagaaccagactgatgatcaagacaagattgaggaaaattgtcataggttttgataaggacctagggaaaaatttctccaaaggacagcaggctgagaagaaatcttacaaacttctccatccctggggctgtcttgagggatccacttacctgggtctctctcactctcttccctatgaacattccttatatatacacatgaagtggcaaagacaaaggcgaagagtagcatcactagtaataaggcagtttcaccaaagataaatttttttcaagtctgatcaaagtgttcctgaaaagagttccttacccttaggagacaaaataatctcagtatactgggagttcaatgaaaatatactggggctcagtccaatttgatttacttaatacactgttgcactaagagatagtcctgaccaggaagctaaaaggatatctgaggaggacaatgaattaaggttctgaattaaggttcttgtgcctaggctgcaaagaggtctcaatctttatggatcttggtgagatctccaagattgttcaatactgaattcctagaaatacaacctgaagaatattttgataaggcaaagctgagtttattcttaatgtggtaagagaaagcaatcccctaatagatattaataacattttggacaaggaaggacaaagttagaatatttatgagactttaaaggctcatttaagatgggtctttaaatgccagggcttgattaggatttggcgaggattatgataaaagagtttactgttggtggacacagcaaagtaaagatttggaggtgagggattcaaaaactcttagaatataagctattgtctgatgttttctactgatgagttaataagtttctaaggaagttcttgtaataaataataaacattattcacaacttttatttttctgagcaagaatttactggaatagtaaagtgaaaatagtgccagtgaaaatagtggaaaatttaaattggaggcaattagccatgagagtgtacatgattttgtttctcacagtgtcagttaacatttcccctctgtgcaaatccttcaatagtttacaatttgtttataataaatgtccgtagaatggcccacaaaactggacctggtcaagccactttctgtcacctcttacctcttagctactacttgctgttctggaaccactgggccagcttctgcaccagattctctcttggccccaagcatttttccaccgtctctctctctctgcttactcctctgccatcatcagttgtcaactaggctaacctggtacacttctctaagtatcaatatcactacaatgttgctctttacccctttccactattttcaacactgatcatgtaatataaaatattatttaatattttaaatgattatccatctccttgcactagaatgtaaacatgctgactgtagagatttttgtctttgtcttttactgctccaacaccaattctctgactttgaaggcaataaaaactgactttaaacctgaaaagaaagagctaaattgccttccagttctttgaagtaaaagtttatacttcaaaagaattgctctggaaagggagaaactgcaagagaaatttcaacttcttgcttctcaaagagaaaggcaaaattatataaaattttgaggaagggtggcatttaggttaaatttataataaacagtatagctgggttagatggaagcaaatggagttggtcagatggggttgatttgatcaaagccaagtggaaatgattggaaggattagagagcagaccagtacaagcagtgcttgctgatgtggacatttaagtgaaaactcattttgaccaattttgcagcttcctgagtatggggtgaggatatcctgttctttaggggataataagattttcagcttcttttgtacatgtgatgatgcctttaggcaagggtgatatttttcattctcatgaccaaagcacagaccataagtctgaacacagaacactatacatggtaatctaggtactctatttgcctttgtaggtgattgcaattttttccttatttaaaattttaagaccataaagaatacttgaaaagtaactttttaccaatcatttaaaaaatactgattaaatgataaaatcccttaaaaacacagttaatgcaaaagccacaaaaagaaatataaaatatagctttacatctgttaaagacactgaacacataattaaaatattcccaaacaacaatgctccatgctgaaatgttccactagtaaatttttacaaatatttaagggaaaaatgtataattttcattttctcaggatagctgacttctagtaactaaacatgacaaagaactataaaaattgaatttacagaacatggctactaggaatatagatccaagtagcctgaacacaataatagtaaatcaaattatgtgaatttttttttttttgagatggagtcttgctctcttgcccatgttggagtgcagtggcacgatctctgctcactacaaccttacaacctccacatcccaggttcaagtgatcctcctgcctcagccccactagtagctgggattacaggcacttgccaccatgccagtttaatttttgtatttttagtagagacagggttttgccatgctggccaggctggtcttgaactcccgacctcaggtgatccacctgcctcggcctcccaaagtgctgggattataggcatgagccaccgcacccagccaaaatatttttttaaaaggtcactgcattataatcatttggggtttacttgagaaatgaagattttttttttaaacattcaaaaaatcattcaacacttctggtttcagctctgatatgtgaggaacttgtaagttataattactgtccttataacaagataaagcagaacaaattgaaaaaaaaatcaattatttcctttaacccatcagagaactgaggcttcagggaaagttgccaccccaaagtctggggacaccgattgatacacagctgaaatttgcttagctggaacagaagccactggagccacaaattgataggaacatttaaatagcaatttagatgaatagctgggctgaatgtgggctagagtgaaaggaagaaactcctgggaacccccacatttttgtgggttctacctccagaacctcaacaatttctcatggtaaagatttaagaaagatcccctcctcctttggaaagggagagaagagtaatcattgtgaaatacacccagagcattcttcataacaaagacctaacctccaggggaaaaattttatctgagccatatctcagtaagggataaggggaagggcattcctttcatttcagccttctctagctttcctgttttaccaatcaggaaataaaaaacccacaattgtcaatagagatcagcacttcaaggaaatagattggaagcaaaagaaggagggaaaagagtagagaggtcaggtggagttgagggagaggttctgccactgaaggaatgtttgtgatggttgtaacaccaagacacaggcacacagagacttattcaaaagatcatagaacactctcccctatgtcttacgaccccaccagcagtgttctgtgtaatagtagattacagttgaaatagctgtaagacaccaattctctcagaggagtacttagggaagtccaaagtcaagagcagaaacaaaagacactagaggaatttggcatttctggtgcctctagtaacagcaaacattaaacaaagcccaattcctcatcagatttctgtaaatagcattctaaagctccatttacctcagtacttactaccagatacagttcaacaaaaaattacaatgcacatcctatgacaagaaaaaacagtctgaagagagaaagcaattagcagaaccagactcagaacaaagatgttggaattaataatagagatttaaaataactatgattaatatgttaaggactcttagacatgcaaaaatagattatataagcagagagatggaaactcaaaagaagcaagaggaaatgctagaaataaaaaacactataacataaatgaagaatgccttcaacaggctcgtaagtagattcagcacagccgaggaaagattcagtgatcttgaagttaggtcaatagaaattttgcaaactaaaatgcaaatacagaaaaagaaaagaatgaagaaaatgggacagaacatccaagaactgtggaacaatttttaaaggtgcaacatagatgtaatggggatactaaaagaatggagtatagagcataatatatgtttgaagtaaaaatggccaagaatttttcaaaattaataacagacaccaaaccacaggcccagaaatctcagagaacacaaaacagtaaaaatgcaaaaaaagcaaaaacaaaaacaataaaacctacaaatatcatattcaacctgcggaaagacaaacacagaaaaagaaatctttaaagaaggtagataaaacatcctcgtcttctcatcaggaaaaaaaatccgaaagtagtaatgtggtagtcaattatggcatatggatgtgtgaaaacaatggcagcaatgccaccagagataggaaaaaaaatggaaatcctctgttataaggcacctgcactaagcgtgaagtggtatggtgtaatttgaagatgggtttagattagttaaaaatgtatattgtagccagggtgacatagcaaaacccagtcttaactaacaatacaaaaattagccaggtgtggtggcacacatctgtagttccagctacttgggaggctgaggtgggaaagttgcttgagcccgggaggcagaggttgcagtgagccgagattgcacccctgtactccagcctgggtgatacagcaagaccctgtctcaaaacaaacaaacaaacagaaatgtatattgtaagttctagctcaaccagttaaacaaataagaaaagataattgatatgctaagaaaggagataaaatggaatcatgtaacatgatcaagtaaaagtagagaacacagtaaaatagaggtcttaaagaaatagtaatgcaatgactagaaagcagttgcaaacatggaatatattgatccaactgtataaataatcacttcagatgtgaattatctacattgaaaaacagaaactctcagaatggactaagacaagaccaaactaaatggctacaagaagcctactttaaaattaaagatttggatactctgaaagtaaagggatggagaaagatataacatgcttacagtaatcaaaagacagctggagtagctatattgattttcagacacagcagaattcagaacaaggaaggttaccaggcatgaaaagtggcaatacatagtgagaaagggccaattctacaagaatatctaaacgtgtatgcacctattaacagtgtcaagatatacatgaggtaaaagttgataaaactgaaaaaagaaatagataaaccctatttatagtcagaggttccaacatccctctggcatagacataaataagaatattgataacctgaacagcattatcagttaagttgtttgatgtttatagagtactccaacaacagaagaatttacatgaatatacattattccaaagtttacatgaaatattcatgaaaacatcatattatgtgccataaaacaaatttaaaagattataaatcatactaagtactcaggtcacaatgtaataaaactagaaaccaataaagaaagacatagctgggaaatctccaaatatttggaaactaaacaacaaacttgtatataatagacacatcaaagaacaagtcattagagaaattaaaaattattttgaactaattccagctggacaatactggttacaatttgtgggatgcagctaaagtagtgcttgcaaggaaatttttagcattaaatacattaaaaagaaaaagaccaataatcaatctgaccttccaccttagaaaaatacagaacagtttaagcaaacagaagaaccttaagcaaacagaagacaagaaataataaaagaataaaaatcaatgaaatttaaaacagaaaaacagtatggaaaaccaagaaaaccaaaagttgatttgtttaaaagattggtaacattgctaaacttctagtcaggctaagcaaagaaaagaaaaaagacaaatgaccaatatcaggagtaaaggaggggacatcagtattgatcccatggacgtgaaaaggataacagaatactaagaacaactctatgcctccagatttgataaatgaaatggaccaataccttgaagtaaactaccacaacctccaaaaggaaaaataggtaacctgaatagcaatatatctattaatgaaattgaaataataattaaccttcccccaaaatagcaccatgcccagagagttttactagtgatttttactaaacatttaaggaagatgcaataccagttctccaccattacttccagaaaatagaaacagagggaagacttcccaactcattacatcacaccatcattaccctaacataataaccagataaaaacattaaaagaaagaaaaactacagaccaatatctctcatgaagattgacgtaaaactccttgacaaaatattatcaaatcgaattcaacaatgtatagaaaaaattagtaccattatgtacattatgggatttattccaggtatgcaaggctctttgaacattcaaaattcagccaatgtagtagaccgtatcaatagcctacagaagaaaaattatattattatatcaatagatgcagtaaaagcatttcacaaaattgaatattcatgatttttaaaatctcagcaatctaggaatacaaggaaatttcctcaacttgatgaaaaaattctacaaaaaaccccatagctaatatcatactgaaatgtaagagactgtatgttaatttcaggagcaaggcgaggatgtcctccaattctatgcaacatcatactggaagtcttagctagtgcaacaagacaagaaaagggaatgaggcatacagattgtgatggaagaaataaaacagtctttactcaaggatgacatggagaaaatcccaaagaatccacaaaagaaaaacttggagctaataagtgagtataacaaagttaaaggatataaggttgatatacaaaaaccaattgcttacctataaaccagtaatagtctattgaaattagaaaaaaactataatagcaccataacaaaagcaaataaaacccttacttataaacctaaagaaaaacaggttcaggatctatatgtctatatgtagaagactataaaactttgataagagaaatcaaagaagatcaaaataaatgaacagatatatcctgtatccatagatagaagactcaatattataaaaatgtcagttcttcctaactttatagactcaattcaattctattcaaaatcccagcaggctattttgtagatgttgacaaagaataaccaacataacactgaagaagcacaaagacagaggagaaatactacctgattttaagacttttactagaagctgcagtaatcaagactttgtggtactggcaaaagaacagatacataagttaatagtacagaatagagagcccagaaatagacaccacacaaatataattaactgacctgtgtcagggaacaaagacaatccaatgcataaaagaatagtcttttcagttaatggtgctgcaacaaggagatgtctgtatgtgaaaaagtgaacctagacataggttttagatatttcacaaaaattaactcaaaatagaccatagaactaaatatgaaatgcaaagtgttaataattctaaaagaatacaagagaaaatgtatttgatcttgggttttgtgatggggaacaccaaagacacagaccatgaagggaaaaaaatggtaagcttttaaaatataagttctgtttggaaaaaggcacttaattaaaagataagccacagattgggggaaaatattttcaaagtacatatctaataaaggtattctagtcaactgtatagagaactcttaaaactcagcaataagaaaacaaatgaccaattaaaaaataggcaaaagatctgaacagacaccataccaaaaaacaaaaacaaatacaaatgataaatacacttatgtaaagatgcttaacattttctgtcactggagataaaaaataataaaataccactacacatgtactcatatacatgtacacagtacacatatacactacacacagtacacatgtattcccatgtaatagaatggctaaaatccatccaaagcctgatcatgccaacttctgttgaaaaggcaagcaacattaattggtgatggaaatgcaaaatagcacagccacttttgaagacagtttggcagtttcttagaaagctaaatgttgtcctgccatatatctagccactacgctccttggtatttacccaactaatctgaaaacttacgtccacataaatgccagcacatgaatattacagctttattcataatgaccaaaacctgaaattaactaaaatatcattcaataggtggatggataaactgtgatacatttatacaatagaatactatcaagcaataaaaaggattaacccatcaagccacacaaaaacatggataaatcatagatgcatattgctgagtaaaagaagccaatctgaaaagaatacatacaatattcttcatttttgtaacattctgggcaaggcaaaactatagatatcaatggttggcagggttcaggcgaaggggcagggatttaatagataaatcacagcaaatctattctgtatggtactgtaatagtgtatacattatactgtgcgtttgtcaaaacacagtgaactttaaagcacaaatgaaccttaatgtacacaaattttaaaaaatcatttaggagtttgggggatccaagatggaacacagtgtctgacaaaagaatccaggtgttttacaaatgtattagacaagcttacgaataatgttggggagaaaagataatgacttaagtaactttgaaaatgagtggaatctgttaagactagaggcaaagtgactgtacaggagcactgcacactatttgataaagttgttttctgtaggtgtatgagttagcaattctaaatcatgatacatatgtatattggaattgaacaattaagtaaatggttggcagatggtgtacattttcttattgttggaatgaaaagttacagacaagaagaaaagaatgatttgtgttgtaatggattagagttggaaacgtcagtgtaaacttatgtttagtttaatatgcagacagatggttacacatagaaatatagatgcatgtatttacatagttattgtacacaccctgtgtcaactgagaatgcttagaagcaatgacactctagtaacaatgggcacacctagaacccagcccttagtttctaataccattctccaatagaacaaatcagggatccttgtagaaatggctgattctaagactggttaggaaatgtacaagatgagcctggagcatcatatagtgccagagagtaaggaagtactaaaacaagaaccccacattgatgaaagtatatcaaagggactcaggaaccaaccaaaagagcttccagtggtcaaatctggaacaaatttttaaaaataaatagcataatattagattacaacccaaagtataaaatatccatgaatccatattgatgtaaataatcaaatgaataaataaactggggagaacatagattttttgtgcagaataatttcatatagtttttatagatacttttgcccttaaggaggttgaactccttactcgtcaagtgtgggaagaaagtcattaggcacattggtgactttctttcaaagagtacagggtggaaatgggggatggaagggaagagtaactgtgcaggggagaaacctgacaagcactatctctacatggtaatcaaggttaacatcagtagtgataaatcatgctgatagtatatacctttgatatgacgtgataaaaattgcactttacctctacagtcttcctcccaaaaacccataagatcagtatcattatgagaaaaatcatcaaacaaatcccacatgagatatactctacaaaatacttgactagttttgctcaaaactgtgaaggtcctcaaaaaggaaagcttgagaaagtgtgacagtcaagaagagcctaaatagacaagacaactaaatggaatatggcatcctatatgggatcctagaagagtaatagtacattatgtaaaactatggaaatctgaataaagtgggctttagttaataataatctatcaatattggttcgttgagtgtgacaaatgtgccatattaatacaagatgttaacaggaggggaaactgggtatagggtatttgggaactctgtttcagcttcactttttaaaaaatcttcaaatgtttacttcaaaaatgaattcaaaatcactcaatgtaaatcactatggtaacataagagagaagaaaagttatatgatcatctcaaaagagaaaaagcatttgataaaatataaaaactattctttataaatctctttattggaactacgaatttatgggaactaaaaattgaaaaaaatttaatgagataaagggtatttacaaaataaattaattgtaaaattattgacagtggagatagagaaagcttttttatgagattgggaataaaagaggattttttttcatcatttctattcattactatactggatgtcctaactaggggagtagagtcatagaataaggattggaaatggaaaggtataagtttcattatttactgacaagaaacaagtctgaacatgatcaattaaaattaggaagttaattgagcaagattgctgggttaaaaagcagataactaaaatgtatttctatgtaaaatgacaaatgaaaaatgaagtttttaaaagataacatttttgggaacatcagaaacatcaattccataggaaaaaattcacacaaaatattatgaaacattatggaaaggaagcaagtaataccttacaaatggagggatataatatattcacagtggcaaattcaattacatatactatacatgttaattctcccccaaattcacttaaagatcccaacgtaagagcattctaaatctgaatgccatttattaaatgttcaatctaatttcaagaattatatatgacacaaaaagtcaagaagagccaagatagtcttgatgaagatgacaattttgcatgagttacatggccaaaatttaaggcctactattgcaaggttacagttactgacaaaagacagaaaactagcctaatggagcaaaatagagactccactccacaagcagatcaatagatatatgattacttgctttatgataaaagtgccactcctgcatgatgaggaaagaatggtttgttcaatagttagtgctggatatcaatacataaaaaagtgaattccttttcaaaccatacagatccatcatttctaggtgtaatgttggtctattcatgaaaggcaaaacagtaaagcttcttgagcatagcataacataggagggtgtcatcataatttggcagaaagtgaaaaataccaataacactaagcataaaggaaaatattgatgaattagtctgcatccaaattaaaatttttatttctcaaagtatataatcagtgaagaagcatcgtataaaagatacaacttgtacatgtcaaaaagttagaaaacacttaaatgggtacttcacaaaagaggatatctgaatggccaataagcctatgaaaaggtattcaaggtcattagccatgagaaaaataattcagacaacaatcagataaacatcttccagtatatctagacagtccccaatttataatggtttgatttatgatttttccactttatgatgttgtgaaagtggtatgcattcagtagaaaccataccttggattttgaattttcatttcccgggctagccactggcagtatgatactctagtgaggctaggcagcagcagtgagccatagctcctagcagtcatgcagttatgaaggtaaacaaccaatacttcatcgcgtactgtgctgccaccattttgacccactgtaggctaatgtaagtgttctgagcacatttaaggtaggctaggcaaagctatgatgttcagtacattaggtgtactaaaagcattttttatttacagtgtttttaacttatagtaggtttattaggaggtaactccttcataaatcaaggatcatctgtttaaaatttgaaagtgtgtgttttttagaattctcttagtattcactgaagttgaatggaggcaacatactctcaggtatatggttaacaaaaattcatgcatgattgacccaaaatatgtatacatgaatgcttatcatggtgccatatctaatagcaaaaattgaaaacaaagtgcccaggaggagttgaaggataagtaaaccttaaaatatgcacatattctctcaaggaacgtggatagtattgtgactgattcttctccatgtgtgatccacatagatgataagatcatcatgagaagaacttaattttatacttgagctttgctttgactgaaagatgagaaattttgtgattattggtatcatctctatgatgtcatattacctagattcacatattcttaactccattaaaatagaaattatatttgtgggcggggaacttattttcatccatctctgtttccttccaattgagcaattccttattttatgttaacctgattttagtggttcattgccataattcttagaaattatatctcattttttcctgtgattttactgtattgaagtaaatctggttggcaggatatacaatattacatgaatgaaatttgcctttggtaactgagaaagttcaaatagaccttggttctagcgaagacttgtttctaaggaatttagattcattctttcagacagtatgaatatcattatggggtcttcttcatgagttatgtatgtgatgggattcttgtaagattttcaccttttacctgagcttgccttgactgaaagttgagaaaattttgtgattcattggtataatttctacagtgcaatatttatttggatctaagcatgcaagtaaaaaaattcatccctgttatagtatttcaggtttgcagtacgttatgacatttgtagatcattgatggactatgaatattcaagggacctggcaattgtacccaggggattgagatccagatacttgtttgtttgcccatagatataaaattaggagcttcctgatatctaatttacttttttaggaataacacccatgagatacagttctcatctactgccctactcctgtccttagataaataacaccggaagaagaagactctctggcctcttacatcagggacacatgaaaagccacactgaatatgtatgaactccaatatactttcacagaagggtttaaggatgccatccctggttataatttttaggaccaaatatatatatatatacacacatacacacacatttaggatagatatatatttaggatatataggataaatatatatatttagtgccatggtttgggtcatgaggaggtttgatgacataaaaattatgctcataagtattatgctgagacccattcttgggaggagatgtgggggtgtcctaggctgtgcaaaacatagctatggaaacagaagttattaagagaaaagaacaagcagtcagtgagaatttagataagagactgtaatagaataaaagtatcagattagtgaatggttgtcctagtaatttggaagaaaaggaataaaaaatggagtcagactactaaatggcaaaaataaagacttgaagaacttaattttatacctgagctttgctttgattgaaagttgagaaatcttgtgatttgtcggtatcatcatctcaaatcaacttatttttcatctcaacatgaagaatatcagctctagccttttggaatttcagcaactcagatgcttgttagaacttatccaggactgcttgcaggacccaaaatactaataatccatatgcctttttttccagctgaaattagctgtcttaagagttgtttttcagtgctctgaggatatccacaaatatatcccaaggcactctgaagtgtgttttcaatctttggccctgcacactggggatgcccactggatgttgcatggagtgttgcctccagttgactttgatagacacaataaacaccacgtgagagccccctcatgaaggagggctgaggacttggagtccaattctccacctcccctgacagataggctattcaatgccttgggaatccgacatgaaggactgcttatagcagtccttgaaaactttctacagaatgtgaactgggagaagctaaatgctgtactcacaagctgggtgacttctccattgatttttaccatagctcactgaaacattttctaaattaacaggtataaattcacagacagatcagaatagatccttggtcctttccatttttctggcacttttgttgccaggaattcaaatacaactaagagaaaaagtgggtagctagcaagaacagatagtttctcaaatattagtggcagtaacccaactttgagaaaatatggagaaagagaagaaaaaacccttaagactgcagtgttagctgcccagttacaattattcacaaagtgagcaaatacttatttgggccaccaataaataagagggcacaagctaacgggaaattaatacgtcactcatgtaaaaagtcaacacattagaaaaaggaatcttggatgagattgagaaagatgcaagggataaaacctgacaagctttacaacctccttgaggaggtcttccctactctgtaaaatcagacagaaaatcattggcaaatggagcaaagcatgggcaaaactgatataatgaggaaacagagctgggaaaggataaatttatgtgtctgtttctgtttcctatcttttaatccttttttaccctttcttctggatactggagcaacgtattctgcaatttctacaggccttttctgttttatcctaaactaggaaaatatccagatataagtatttctggactatctgctacctcttctttctcctctgaggttttcatgcaaataggcgaggtcctatttgcataaaataggaagaatatgccttgtctcctaatatgcccaataatcttttaagaaagggcctgctgtgtaaaccaagggctatgatcttctgtactctgaagagagtgcttttggagcttctgggatgcaaggtatctacattgctaaatatgtgctttctgaaacaaaagatggctgtgggagagtaggagtctcactcaatgctggagaagcactcccaagttacagaaaataaacccatatctatgagtcctaggaacaaatgataaagatttaacaaaagagatcaataccattgttgtaacttacaacagagaaaaaccttggccatgtatagaacattttctctatttttacctcaaatatgatgtaattagaaaaattttaaaaaacgtggcatagttaaaaaaaaatggcacattcacttcataatgcttccatattgcctgtgggaaagttaggaaaacttgacagggaaggtcaaactgtttatagatttatgcatgatcttagagaaacaagttgtgattcctctgacacttgtaattcccagccttgccactgttttaatatctgttcctgagttatctaagtatttttctgtcatggatttatgttcaatgttttgttctccatgtttagctggggagtcgaggttcctgtttgagtttacctgtggagcgggaggctttcaatatttgtggcaacggatcttcctggaattcagagagtcacctactccattctctgggcatttataagaaaatataaagaatattcctcacattaggattccatactaattgttattgatagctgctaataacttacatgctagtaaagaagacattttagctttactaaatttcttagactcccaggacgtaaaacctcgctagctaagttgcaatattaccaactgaagtaaaatatttgggatctgtgttattggcagatggaaggtggttgcatcttgaagtcagcctaatatacaaatgaaacaacatgccaaaaaaaaacttcaccgattttgaggattaattgtagatctttgcgttttatgaaaaggctaagcctctcactgagatgttacatgaaacatcactagaactctttattaaagtcaaaataaggctgaagaagtcttttatgcccttaaaatagctgctatttcttcacttgtattacttttttaaccttgttaaaaaaggagttctaccttttctgtcttgagattaagggttactccaaaattaggccttgattataggcacattgcttactttcccaggttcttgtattttgtctctctggaaatgcgatgatatttataaggtacagtggcaaccactcccctgattaaaaaggctcattcagtccttgactctgagaaatttaacttacttacaggtacttcatgttgttactgctattttacaagttcataagacacaacacttgtcagtatgctgtcaaacgagctaagaacaagtcttattgtgtgatcctaatgctattctaggaaggtgtaaccttttgacagctattctgtggccagatcttgacagaataagttgaacttgactgtctcagagtgattgaggaagacactggagcatggtctaatttttgtaatattcctattcccaatgttgactgaatattcatgaatatattctgtgtgaaagacccacaaaggaatataaaagcatgttctacggtaatcaaccctcatgaagcttagaggcttctgtttttcgaaacataaaatcagcccaagtggcagaattgtagttattataccagctgttaaattagccaccagttataaagcagatatctatactggtaataactatatgtttgtggtctgttatgtgactagccaactttggaagaatagatgctaacgtcaataggaactaaaatattacatgagaagctaatttctgatttagtagagtcattcaaacttctctaacagatttatgtaatttattgtagagctcacagtggaaaacaagattaactctttaaaaagaaattaatttgcagacctagctgtgaagggcttctgacgtttagactggggaaatcaaacctctatcacttctgtccaaaacctcctattcataatttcagaaatagccaactctcttaagaattagaaaattaggaatgaaggagaactaagatgaacaccataggaaaatgagaattacataatgaaatctttcctttattccgattgttatatgattgagtggctttttcatgccaccaacaagttcgttcaagcaaaaggaatatgctgacaacttgaaatctttgtaatagcatcatataattcaggaaataatatgaagatatgctctttgtcagaaaaattctttccttacctaaaataagtcaagaaagcctactaaggcccatgatacctaggatctgctggcacaagaactttatagaacttccacctttagaagatagtaaatatttttaccagtgttgtgtattggtgtctggataggctaaagcagatgctcaaacagtgatcaagctcttactgaatcatatcatctcaaccactggaattcctgaatatctggaattcagtaggggaatcattctgtatttgtgggaattcgggaattttgtaatactctacaaataccaataatttacctacctgttatccccagtcttctgaacaagtggaatgagtgaaccacataccctaaagaattatttagctgaattatttagctaagttatgtaaaaccttaccatccgtttcatttaaaataagattaaatccctctagcaagcccaacattactccctttgagtttggaaggtctactaatcttgggcttaagcctaaccctttctctgatacaatggaaaatcctcatgaccatatatgatacttaaagagtttgtgggtttccctaggctcaccttgccaacatgtggccagatgctgaaaaagccgcctggggaagtgtgtcattgatattgaacaggagattcagtctatatcaaagtgttctgatgacagactgtgaccacactggacagaaccctatcaagtgtggttgagaattcatagtgctatcaagatgaaggagaaacccaagtggatacacgcttcacatgtgagaccaacatccaccatcgagtggggtataattcccatttaggaccttaaggataaattctctagatagtaaccttgaataatatgcaagctaaagagaaaaacttatttgatagacagcaggagagatagactgttttgttattaatacgttcttcttaattattttgaccattataattttgatacttagtttgtattaattttgatacttagtttgtatcaattgaacataaagcttattattagtctttcttttaaaagttagtatctcaacctcaaggaattttgtggtaattaaaaattgtcctgaatatgagatcaggacttaagaaacccctttctttgtcataatacttcaaactcaccaactggatgatttaaattcagaagacatgaaaaatttcaaatcttcccactgattagtcaatattacaaaaatcttaaatatcatcaccctttgtgttattgaagatactgatgagaagaaatttttaactaattaagttgaacgtaattatattcaaattgaaagtccctgaagggtatcacaaaactccaacaactctgtatcttttttttttttgagcagagtttcaccttattgcccaggctagagtgcaatggcacgatcttggctcaccacaacctctgcctcccaggttcaagcgattctcctgcctcagcctcctgagtagctgggattatagacatgcaccaccatgcctggctaattttgtattttttgtagagatggggtttctccatgttggtcaggatggtctcaaacttccaacctcaggtgatccacccgcctttgactcccaaagtgctgggattacaggtgtaagccaccacgcccggcccaactctagatcttaaatagccatgggggtccaatttaataaagcttaaatagacacacagatgagaaaatatcccagcccaaatggtgagggttagtttcttcaaaacccccaaaacgtatcatcacctaaaaatgagcttaccctgtttagaacctggcagtctccagtccccatacttacaaactcgaggataattaaatggtctgtatcatttaatattacaatagctaatgtgagtaaactgaattctacttgtacatgataggctttaccactatgaaatgtttttacacagggactaaaatggcactatgatcaaactgaaagagatttctttttttaatagatggggtctggctttgttgcctacactggagtgcagtagcacaatcatagctgtctatcgcctgtaactcctgggctcaagggcttcctccgtctcagcttcctgagtagctgggactacagggacatgccaccatgcctgcctatttttttttgtagagtcagggtcttgctcaggctggtttcgaacttctggcctcaagtgatcctgctgcctcggccttccgaagcactgggttcgcagacataagccaccatacctggccagagattattaaatacagtattagggggaataaaactaggactacaattgtaaactcttctgatatagaaacaattactgataaacagtgcattggacaatttgcagaaagatgcaaacatgatagaatcaaaatctaaacaagatatgacaaagaaaaacaaaaatggaattgggaaagcatttggaattggacatctggtaataaaattctattgcaaaaaaatatatagtaaagaattttcagaagccttcacttgcattagtgcacaaccactggttattcaacaactacaatgtatacttgctggtactgaagtacaagattatacctactcagacaaacaattaggtattggacatactactgtctatgtagagattaaatgatagtgtaaaaaggttgatcatattataggtaaaagagctgaaatctggcattgcagattgaaatttctgaaaactgaaataataaaactaatttcactaaagtatgtacattttcttatttacatagtttataatgtgttatataattcatgaatcttcaaaagaaatatactgagctattcaataaaaatttacattacagctttaggccaccaagccccatctattgattatgtacttggtgtaaattggcggggggaacaaaacaagagtgaaaactgagcctcaaaatacaaagcatgtagcaaaacagactactaaaattattctcaatttctaagcccattatatgatgcaggagaattcttatgtgtaggtaataaagaatctgttcaaatatgcatcagtggtatgacagtttcaaataacccactgaactaggaaatattcaccaccaaggaggtcaggtatactgatttggtcaacctggatattgacatgggatgttcttacggattgacagctccacttgatgctatcctatcacaaaatattattacctgatgttgatataattaacaagtcaatacaaaaagtaaggtctctctacaagacaagactaacatctctgtaatataaatgggactctgagtgtaatagatttagggtttctgcaagaattttgaaagttaaggatccaacgcctgtaatcccagcactttgggaggccgagacgggtggatcacgaggtcaagagattgagaccatcctggccaacatggtgaaaccccgtctctaataaaaatacaaaaaaaaaaaaaaaatagctggacatggtggcacacacctgtaatccccgctactcgggaggctgaggcaggagaatcgcgtgaaccagggaggcagaggttgcagtgagccgagatcgtaccactgcactctggcctggcaacagagcgagactctgtctcaaaaaaacaggaaagcaaaagaaaaagttaaggatcctaccaacaaaattggaatatgagactgaggaaattcctattccagctaaacccagaattgattatgttgatgaacacatgaatttcatgtgtgtgaaaacatatgaactcctcattgtcagtctaatgagagtgaaaacaacacatcgaagatgcggggagacgacaatacagagtgggctcataactgcattctagatactgggattactttccattaaggtatataattttagaatatctcacaaatagcccatgcaaaatcctgcggaaaggcaaccataaatatagagagaatatgtaaaaaagtggcatggtctagtatatgccaaacaaggcaagggtatacaaaaacctcaaggtcccagtatgacaaatcatgcttgtattgcacacccattaaaaagtcttctaaaaagtttttttaatggtgtgcaggcaggtttattcagaaaaagctcggattcatacttgtaaaagtctgagaaaagcattaaaatgctattatgatacagttgacccaaacaacacaggtttgagctgtgcaggtccacttatctgtggattttcttctacctctgccactgagacagaaagacaaactcctcctgctcctcagactactcagcatgaagatgaggatgaagacctttaggatgattcacttcttcctaatgaatagtgaatgtattacttccttaataacgtttttttttctctagcttcttgtaagaatacagtatataatatatgcaacacaaaaaatacgtgttaatcaactgctttatgttatcagtaaggcttccagtcaatgggagactaactactaattaagtttttggggagtcaagttatatgcagattctccactgagcaaatgttcagcactcttaactcctgtggtgttcaagtgtcaactgtatatatgtttaagagttattgtttacccagtagatcaagccaagaccaagttaggtttatgtgtttttggcttaacctaagaaaatgttcagactaaagcagtccatcaatagaacagactgccttttaaaccagggaacaacttgtctttgtaggtattttaggtatatgaatgaccatatgtgatctgctttgggtcatctatggtcccttccaacttaaaacttctctattcatgaacattgcataactgaattgtggatttcatataaataatatcttgttgcctactttaggtttgaaatgttttccttctcagttgcatagatatgtatagcaccatccccactatgaactctcatgtagaaaataccagattctaaagtcatctgtgaggctaaatgtcagacttaggcacttccacataatgctgcaaaaagcaacagcttaaaggtattacttgctcaacatgtcattccaaacacatacactatgattagcagctgaatttaacagtatctttccactttgaaaaacactttatatacctttacaaagaagccatagtatctcagggtagaaaaactcaacaggtagaaaacatggccttctcttagaaatgagctacgtaattttgagtacttatctcaaaatcattgcagaaacatatctagtgcttatggaaaaagaatcaaaagatctttttttttagctaaagattttgagtttttcttgtgacatttaagtcttttaatgtatgctgatttttatgattatctaactgtttcataatggttattcttgcctccatgaaagggaagactagaacaaaaacctgacaagaacaagttctagctccatcaccgacttactgagtgaccctaggcaaatcatgtgggctctttcttgtgttttaagttttacctccaatgaagtaactgcctcagactagctgtgaagctctcataaagtgatggatttgaaaatgccttgcaaagaatgagcagttaatacatagaaagtttcatgtacttccgtatattgcatgatgcccacccagggttaggttgataacagttgttgatccaataatgaaagaaataaaaagaactctttaaaataacgaagtaaaatagctaattttcctgttgtagttttaaaaattatataaactatataactaaacatatttatgtttattatatataatatgatatgcaattacataagacattattatataatgtttttatataatgcttaagtaattaaacaattatatttaaatataagttatactttccttccccagataagacaaagaacctgtttacttctctgagggatttattggttcctgtgaaatctgtggaggccgctaacactccatagccagagaatgacaacatatgattttcttttcagtcttgtagtatccacagtagtgatgtctgtccatgtacaagtgtctgtccaggacatccattaaattccatgcctgctctgtgtgttatgagggcagggacagaagacagattcactggtggtactttcaaacaatgtggtaggccttccttttggggtctgccatgacaatgataccccaggcggcaatgctaaggcccatgaccatcttcataatggtccatggacccggggggtatcccatcttcatgggcttctgtgccacccagtacacatacccgcctgcccccatcagccgcaacccagaaagcacgtgacagctccagcaggtctccaacaggtggtgttctgctggtgaggtcggcgatccgggtgtagctggggttgcaggcttggcaggcacggcggcggtatcgggaggcacagcgatcttgagggactcaaaaggctgggacaactgagaccccgtgttctggaactcggcctccctaaaaattatgttttaaaaaatacatagaatcggtaagatgaggaaaaagcataaaacggtcaaaaacactgggataattcaaggttcattttgacaatggtaatacaaatagaaaaactgacaaaaaagaaaatacatcttacattagaaaacatacaagagtagttgtatacaaacgaagacacgtaccaaaaataagttacaaaatatgaatgcatatacataaaaaatgtagtttcaaacaattcaaaagtaaaatgatgcaagacattaaaatattcacaaacacgctcgaaaaataagagctgacgcccaaattagaccagttcaacggaagtgtggggtgtggttggggatccgccgcagaaatcacgtggcgcccaggccaaggctgcaatttcccatgctgcttggagaagacgcctgggagggctcccaccatgcccaggggcaggctatgtgactgcccggtctgcagctgtaagtggtttctgggccagtctctttgtctggtcatgacctggttggtggccctagcttgtgccgagtggtcccggagtggcccagggggttgtgtgtggggagccagcgtgggcagcggaggtgctccctggggcctgcagtagggcacagcctctgcatcttgtgtgagcccagtgacccgcctgtcctgtccttccagggttgggtggcagggagggccaagggtgccctgcgtccgtgacgggtcagcgtttccagcaaatgggtccatggagggagagcctagctgagccggcgggctctaccaccttcatgaggttctgtttggacacctgtcctactcctgttcccccagatggtgaccatggaggaagacttgtgttgggcccaatggccctcggccagtgtccgtctgccaggtgccagcccccggtgcgctgaagctcaggccattcctgatgccctggcctcctgcactgagctgtggtgagcccatccgggtcctgctggatacatgggcggggaggggggtgccctgggttgtgttgatgatgagaaccttatattatcctgaagagaggtgatgacttaaaaatcatgctcaataggattacgctgaggcccagcctaggtgagaattttggaagaggatgctgggatccagaggcccccgacggggccactgtatttcgggctgcagacctagaggccctgaagggcatctgaaggtggcccaagcctatctctgagcaaccccgtgaggcagtcaaggatccctgtgtgggcataggctggggctctggttccctaggggcagggcatgtgggtggctcctccctgacccccattctcccctgtgtctttcagtgagctcttctgcccaggcaggccccctggcattgaccggcataggtgagtggatcctgctggggtcatgggccatgagccaggctgctggggtcgccaagggtcagcctttgggacaggagggtttccttagggagccaacctgaatccccactggggagggctaggttctccaggagggcagcttccttgggagtctgacccaaggaggatatcttctctaaagccctgcagtggtgagggtggtccaggcagcaaagggttccttcaaccccacccaggacagcgcccagctgagactcagtgtgcaggtctggccatgaggactgcccaggtcacataagggggtccataggagctccggggcaccacaggggtcacacaggagctctccttccccagagaggggtgagcgattgggcctatggggtcaggcctttggagatcaaggattgggccccacccatgaacctgaatgggactgagcctttgagcaatggaccatcccagtggtgcctcggagcctagtcgggggtgatgtggcttcaagggggttgggtcaaggctgagctctggccggtgcctggtagtgctgcaggctggccctgggactcgctggctttgggcaaaggggccagcccgtgtcccactggaggtcaccccttccctgtgggcaactagcaggaagggtggcatccttagctgggaaggcccactgtcgagggtcctgtccagggaatttgcctcccaggcttcttctgatccacggactcacctccagggtggtggggtcttgggcccgaggaaaggagaagataccctgtgttccccagttggctgagtgtggcttggctctgtgtttgggaggtgtgtagggtatgaatggggacccaccagagaacacacatggcccagggccccaggttatgatttcccatgcacacttggagagaactctgggtgagtgccctccactcccaggcacaggctatgcaactgccaggtctgcagtggcatgtggcttccaggtcagcctccttggttggccatgagcaggttggttgccctgtcctgtgcccagtggtcttggagtggcccaggggtcctgcaggggagctggtgtgggtagtggaggtgcttgtggggcctgcaatagagcgcagcctaggtgccttgcacgagctcagtgacccacctgccctgtcctagtcctagctcagtgacccacccccgctttgcagtgatggggagtaccaagcgtctcctgcgtctgtgatgggtcagtgttcccatcacatgggtccatggagggagagcatgcatgagctggcaccacccaccaccttcccactatggaggcgtgaggccatgtttggacacatgtcttcttgtccccccagacagtgagcctggaggaagacttgccctggtcccactgtccctgggccagtgtccatcagccaggtgcccagaccccagtgcgctgaagctcagccctccctggcactctggtctcctgcactgagctgtggtgagcacatccaggtcctgctggatgtttgcatggggaggggctttccccgggttgggtcgatgatgagaagcttctgttttcttgaagagaggtgatgacttaaaaatcatgctcaataggattatgctgaggcccagcctaggtgagaattttggaagaggatgctgggatccccggcaggagggattttgggctggagacctggaggccctgaagggtatctgcaggggccccatccctgtctctgcacttgtctgtgaggcagcccagtttccctgtgtgggcttcgtgtcagtgctctggttccctggagcagggcacgtgggtggctcatccctgaagtcacgttctccctttgtgtctttcagtgagctcttccgcccatgagggccccctggccttgagcagcataggtgagcggatcctgctgggctcatggaccaggccacatggggtcactgagggtcagccttcaggacaggagggattcctcagggagacaacctgaatccccactggtgagggattggttctccaggagaaccacctccttgggaatctgacccaaggaggacaccttccctgaagccctgcaggagtgacagtggtccaggcaggaaagggttccattagtcccatgcagggcagctcccagctgagacttggtgctagggtctggcctcgaggactgcccaggccacatgaggcagggtctcaggctgctatttccagtgcatgcttggagagggagcctgggtaggccccctccctgtgcaggggcaggctgtgcatctgctggggctgcagcggtgcctgccttcaggaccagcctccttggttggcttgagctggatagtggccttggccccacccaggggtcatggtgcagcccaggaattgcaggggagctggcatggggagtggaggtgctccaggggcttgcagtagggcacagcctgggcatcttgcttgagcccagtgaccagcctgccctgttttccagggttcagtggcagggaggaccaagggtcccccacgtccatgactatcactgtttcacatggatcccatcaggtgggtccatggagggagagcatgtgtgagtcagcaccccctgcctcctttcccgcatggaggcatgaggttctgttcggacacttttccctgtctctccagatggtgaccctgaaggaggacttgtgttgggcccaatggcctggggccagtgtctgtcagccaggtgcccagcccctggcgtgctgaagtttgggcccttcctggtgccctgttctatcgggggaacccgcccccaataattcaacgtaggtccttttctattttccctaagtgtcggccggtctgagaaataaagggaaagagtacaaaagaaagaaattttaaagctgggtgtccgggggagacatcacatgtcggcaggttccatgatgccacccaagctgcaaaaccagcaagtttttattagtgattttcaaaggggagggagtgtacaaatagggtgtgggtcacagaaatcacatgcttcacaaggcaataaaatatcagaaggcaaatgagggcagagcaccagggccaaattgaaattgctaatgaagtttcgggcacgcattgtcattgataacatcttatcaggagacagggtttgagagcagacaaccggtctgaccaaaatttattaggcaggaatttcctcgtcctaataggcctaggagcgcttcgggagaccagggcttatttcatcccttatctacaactgtataagacagacattcccagagcggccattttagagacctccccctaggaaggcattctctttctcagggttgttccttgctgagaaaaataattcagcaatatttctcctattcgcttttgtaagaagagaaatatggctctgttccgcccggctctcaggcagtcaggcctgatggttgtctcccttgttccctgaacatcgctgttatcctgttcttttttcaaggtgcccagatttcatattgtttaaacacacatgttttacgaacaatttgtgcagtgaacgcaatcatcacagggtcctgaggcgaaatacatcctcagcttacgaagatgacgggattaagagattaaagtaaagacaggcataggaaataataagagtattgatttgggaagtgataaatgtccatgaaatcttcacaatttgtgttcttctgccatggcttcagcaggtccctccgtttggggtccctgacttccctcaacactggtctcttccactgagccttggtgagcccatctaggtcctactggatgcatgtgtggggaggggggtgccctgggttgggtcaatgatgagaaccttatattgtcctgaagagaggtgatgacttaaaaatcatgcttagtaggattacgctgaggcctagcctaggtgagaatgttggaagaggatactggatgctgaggtccctggctgagctactgtattttgggatggagatctggtgactctaagggcacctgaagggccagaccctgtctctatgaggcagcccaggctccctgtgcaggcttgctgttggcactctggttccctggggtgggacatattggtggctcctccctgagccctgttctccccttgtgtctttcagtgagctcttccaccaaggagggccccctggcattgactggcataggtgagtggatcctgctggtgtcatgggccatgggccaggccacgtggggtcaccaagggtcagccttcaggaaagaagggtttcctcagggagccaaactgaatccccactgggaagagatgggttctccaggagggcggcttcctgggaaacaggaaccaaggaggacgccttccctgaagccctgcaggggtgacggtggtccaggcaggaaagggttccttcaattccacccagggcagctcccagctgagtctcggtgctcgcgtctggactgccctgactatgtggggggccacaggggctctggggtgccttgggggtcacacaggtgctctttgtccctggagaaaggtgggtgatcaggcccatggagttgagcagtggagattcaaggattgcacctgacacatggtcctgaatggaacccaccctgttgagcaatgggccatcccatgggcctcttcaagcctgaagaggggcggtgctgtttcactgggtttaggtcaaggctgagctctggccggtgcctggtggtgctgcagtctagctgttggactcgtgggctttgggccagtggggcagcctgcatccctctggaagtcaccccttccctgtggctggaagttaccccttcccagtgggcgaatgtggggaagggtcacctcctgaagtgagaaggcccactattgagggtcctgtcctggcaatttgctgcccatgctgcttctgagccatggagacacctccagtgtggtgggatcttgggcccaaggaagggagaagacactgtgccccccgattagctgagtgtggccaggctgtgtgtttatgaggtgtgaggggcatggatggaaactcaccagagaaagcatgtggccctgggaccccaggtcgtggtttccagtatgtgcccagatacagcacatgggtgggtgcccaccatgcacagggactggctatgtgactgccagctgtgcagcagcatcaggcatatgggccagcctccttggttgacaatgaactggttgctggccctggcctgtgcccagtagtcctggggtgaccctggtgtcatacaggggagctggcatgtgtagtggaggtgcttgtggggcttgcagtagggcacagccctggcttctagcctgagcccagtgacctgcctgtcctatcctttcggtgttcagtggcggagagagcattgggtgccctgcatccatgatgggtaagtattccacatggatctcatcacatgggtccatggaaggtgagcatccctgagctggcacaccacaccttctgtccacatggaggggtgaggttgtgtttgggcacttgtcctcttcctgttccttgagatggtgaccccagaggaggacatgcgttgggcccgctgtccctggccagtggccatcagccaagtgcctagcccctattgcactgaaactcgggcccttcctgtcaccttggtctcctgcgttgagcttgggtgagcccatccgggtgccactggatgcctaggcagggaggggggtgccctgggttgggtcgatgatgagaactttatattgttctgaagagaggtgatgacttaaaaatcatgctcaataggattacgctgaggcccagcctaggtgagaattttggaaggggacactagaatcccgaggtccccagcagggctgctgtattttaggctggatacctcgaggccctgaagggcacctcatggaggggcccaatcctgtctgtgctcctctattaggcacaccagactttctgtgtgggcttggtgtccacgctcagcttccctggggtgggacacgttggcggctcctccgtgagccccattatcctctgtgtctttcagtgagctcttccccccagcagacccctgggattgacgagcataggtgagtggagactgctggtgtcatgggccatgagccaagctgcgtggggtccccaagggtcagccctcgggccacctgggtttcctcaggagctgatctgaatcccaactggggatgtgttctccaggagggcagcttccttgggaatcagacataaggaggaggccttctctgaagccccgcaggggtggcagttgtccaggcaggaaagggtttcctcagccccacgcagggcagtgctcagctcagacttggtgcttgggtcaggcctctaacatggccaggccacatgaggggggcaacaagggctccggggagccaagggcatctcacgggggctctccaaccctggagaagggtgggtgattcggtccatggggtcaggccatggagattcatggattgcagcaaacccaggaccctcaatgggactgaccctataagcagtgggccctcccagtggcacctctttgagccatttgtggggcggcgctgtttctctgaggttgggtcaagactagctctggccagtgcctgatggtggtgcaatccactcctgggactcgtgggctctgggccaaggctgcagcccatgtcccgctgggggtcaccccttcattgtgggcgagtggcagtaatggcctcctgagttgggaaggcccgcagtggaaggacctttcctggaaatttgcagtccaggctgcttctcagccattaggacaactccagcgggttggggggcaggggcgggtcttaggcccaaagaaaggagaagataccatatgtctcccggttggctgagtgtggccctgctgtgtgtgtgggaggtgttgtgtggggcatggattgggacacaccagagaaagcttgtggccctggagccccaggctgcgatttccagtgcaccttgaggaaaggagggtgggtgccctccatgcacagggcagactgtgcaactgccaggtaggcaacagcacgtggtgtccgggccagggtccttggtttgctgtgagctctttggtgtccgtggcccctacccaaggatccagataccacccggggtcatgcaggggagctagcatgggcaatggaggtgctcaaggggcctgcagtagggcacagcccaggtgtcttgcctgagcccaggaacccacctgccctgtccttccatggttcagtggctgggagagcaaagggttccgctgatctatgacacatcagtgtttcccatggatcccatcacatgggtccacggagagagagcatgtgtgagctggcacccccaaccccattccctgtatggaggcgtgagcccatggttggacacatgtcctcctcctgtccccccagatggtgactgtggaagaagacttgctttgggaccgctggccccaggccagtggttgtcatccaggtgcccagcccttggtgcacttgagctcaagcccttcctggtgccctggcctcctgccctaagctgtggtgagcccatccaggtcccactggatgcatgcatggggaggagggtgccctgggttggatcgatgatgagaaccttatattgtcctgaagagaggtgatgacttaaaaatcatgctcaataggattacgctgaggcccagccttggtgagaattttggaagaggatgctgagatcccaaggtctctggcagggccactgtattttgggctggagacctggaggccctgaagggcatcttaggggtgcccgaccccatctctgcgctcctccttgaggcagcccaggctcccttgcgggcttggtgtcagccctccagttccctggggttgaggcacattggaggctccttcctgagcccccattctcccctgtgtctttcagcgagctcttctgcccagggggacccctggccttaagtgggataggtaagtggatcctgctggggtcgtggaccatgagccaggtcgctttgggtcactgagagtcacccttcaggccacgagggattcctcagggagcccatctgaaacccaccagggacggatggtttctccaggaggacagcttccttggaagtcggtcccaagaaggatgccttccctgaagccgtgcagagatgatggacgtccaagcaggaagggcttccttcaactcaatgcagtgcacatcctagctgagactcagtgcacaagtcaggcctggaggacttcccaggccacatgagggggtccacagggtctccaggggccacgggtgttatgagggtgctctctgtccccgaggcttgcagaggggcagggtgtgggtgatcggacttatggagtcaggccgtgaagattcaaggattgggcccaacccatggcccagcatgggccgaacctgtagagcaatgggccatcccggtggtgcatccttgagccttgtgggggtggtgtgaccttagtggggttgggtcaagcctgagctctggccttcacctggtggtgctgcaggctggccctgggaatttgggctttgggccaagggtgcagtctgtgtcccgctaaaggtcacccctccccaaagtggagtggccagaaggatggcatcctgtggtagaagtcccactgtcaagggtcctgtcctggcaatttgttgcccaggctgcttctaagccatgggttcacctccaaagtggcggggtcttgagccgaaggaaaggggaagacatcatgtgttccctgattgactgagcatggcctggctctgcatttggaggtgtgcggtgcacgaatggggacccatcagagaaggcatgtggccctggggctccaggatttgatttctggtgtgagcttttacagggggtctgtagtggcacgtagcattcaggtcagcctacttggtttgctctgagcttgttggtggtcctggccctgcccagtggtcccattgtggcatagagtcatgtgagggagctgtggcaaggagggccaagggttccccacattcatgatcgttactgtttacatggatcccatctcttgagtccatggagggacagcatgtgtgagccagcaccccctgcccactttcctgcatggaggcgtgaggccgtatttctatacgtgtcccccacccctccagatggtgaccccagaggaagacgtgcattgggtccgctggccccaggccagtgtctctcagccatgtgctcaacacctggtgagctgaagctcaggcccttcctggcatcctggtctcctgcactgagctgtggtgagcacatctgggttcctctggatacgtgtgcagggagggggatgcactgggtcgggtcaatgatgagaaccttatattgttctgaagagaggtgatgacttaaaaatcatgctcaataggattacgctgaggcccagcctaggtgagaattttggaagaggatgctgggatcccaagttccccagcatggccagtatattttaggcaggagaccctgaggctctgaacggcatctccggggggcacaaccctggctctgggctcctctgggaggcagcccaggttccctgtgcaggcttgggctctggttccctgagcccccattctccctcgtgtgtttcagtgagctcgtcctcctaggtggggcccccaggcattgaccggcataggtgagtggtcctgctggggtcatgggtcatcagcaggttggagtcaccaagggtcagcctttgagacaggagggtttccacaggcagccgacctgaatccacaccatggagggatagattggtcctccaagagggctgttttttttcggaatcagacccaaggaggataccttccctgcagccctgcggggatgacggtggtccaggcagggaagggttccttcagtctcacgcaggtcagctcccagctgagtctcagtgcattggtctggcctccaggactgaccaggccacgtgaggggggcaacaggggcttcgggatgcagtggggtcacacaggatctctccatccccagagaaaggtgggcatagaacccatggattcgagctgcagagattcaagaatcgcacacgaattattgccctgaatgggacccaccctgttgagcaatgtcccatcccagggcacctctttgagcctgaagggggtggtgctgtttccctaggtttgggtcaaggctgagctctggccagtgcctggtggtgctgtagtcctgtcatggactcgttagctttacgccaaggggtcagcccacgtcctactggggatctccccttccctgtggctggaagtcaccccttccccattggcaagtgtcaggaagggtgacctcctgaggtggaagtcctgttgagggtcttgtccctggaatatgccacgcatgctgcttctgagccatggggtcacctccagggtagcgggtcttgggcccaaggaaaggagaagtcaccatgtgtcccccgattagccaagtgcggccctgctctgtgtttaggaggtgtgtggggcatggatggggacccaccagagaaagcatgtggcccagggaccccaggttgcaatttctaggacatgctgggatagggcacctgtgtgggtgtccacagtgcacagggataggctatgtgacttgcaggtctgcagcggcatctggcatccaggccagcctccttggtgggccgtgaactgaatggtggcgctggcctgtgcccagtatatctggtatgaccctggggtcgtgtgggggagccggcatgggcagtggaggtgcttatgggacctgcagtaggacacagtcggggcttcttgcccaagcccagtgacccgcttgccctgtccttccagggttcggtggctgagagagcttttgttgccctgtgtccgtgacgggccagtgttctgcatgcatcccatcacatggatccatggagggtgagcatccctgggctgacacaccccaccttctgcccccatggaggggtgaggttgtgttttcacacctgtcttactcctgtttccccagatgttgagcccagaggaagacttgcactgggcccaatggccccaggtcagcgtccatcagccaggtgtccagcccctggtgcactgaagatcgggcccttcctggtgccctggtctcctgcattgagctgtggtgagcacatccggatcctgctggatgcgtgtgcggggaagggggtgccctgggttgggtcaatgagaaccttatattgtcctgaagagaggtgataacttaaaaatcatgctcaataataggattacgctgaggcccagtctaggtgagaggtttggaagaggatgctgggattccgaggtccccaggagggcccctgtatttttggctggagacctggaggccctgaagggcatcttgtgggtgcccaaccctgtctctgcgctcctccttgaggcagcccaggctccctgtgcaggcttggtgtcagccctccagttccctgggtttgaggcacatgggaagctcctttctgagccccgttctcctcttgtgtctttcagtgagctcttccacatggaagacccctgtcattgactggcataggtgagtggctggcatcatgggccatgagccaggccgcgtgaggtcgccaagggtcagccttcgggaaagaagggtttcctcagggagccaacctgaatccccactgggaagatatgggttctccaggagggcgacttcctgggaaacaagaaccaaggaggtccccttccctgaagccctgcaggggtgacggtggtccaggcaggaaagggttccttcagttccacccagggcagctcccagctgaggctcggtgcttgcgtctggacttaaggactgccctggccatatgaggggtgccacagtggctctggggtgccatggggtcacacaggcactctctgtccctggagaaaggtgggtgattgggcccatggagttgagctgttgagatgcaagttttgcacctgacacatggccctgaatgggacccaccctgttgagcaatgggccatcccatgggcctcttcgagcctgaaggggggcggtgctgtttcactgggtttaggtcaaagctgacctctggccgccacctggtggtgctgcagtccagcccttggactcgtgggctttgggccaagggggcagcctgcatcccactgaaagtcaccccttccctgtggctggaagttatcccttcctcatgggcgagtgttgggaagggtggcctcctgaagtgggaaggcccgctattgagggtctgctcctggcaatttgctgcccatgctgcttctgagccatggagtcaccaccagtgtggtggggtcttggacccgaagaaaggagaagacactgtgccccccgattagctgagtgtggccaggctgtgtgtttgcgaggtgtgaagggcatggatggagactcaccagagaaagcatgtggccctggggccccaggttgtggtttccagtatgtgcttggatatggcatatgggtgggtgcctaccatgcacagggactggctatgtgactgccagctgtgcagcagcatcaggcatacgggccagcctccttggttgaccatgaactggttgctggccctggcctgtgcccagtagtcctggggtgaccctggtgtcatgtaggggagctggcatgtgtagtggaggtgctcgtgtggtctgcagtagggagcagccctggcttctagcctgagcccagtgacctgcctgtcctgtcctttcagggttcagtggcggagagagcatcaggtggcccacgtctgtgatgggccagtattccacatggatctcatcacatgggtccatggaaggcgagcatccctgagctggcacaccccaccttctgccagcatggaagggtgaggttgcatttggcacctgtcctcttcctgttcctcgagatggtgaccccagaggaggacttgcattgggcccactgtccccgggccagtggccatcagccgggtgcctagcccctgttgcactgaagctcaggcccttcctgttgccctggtctcctgcattgagcttgggtgagcccatccggttgccactggatgcctaagcagggaggggggttccctgggttgggtcaatgatgagaaccttacattgttctgaagagagatgatgacttaaaaatcatgctcaataggattacgctgaggcccagcctaggtgagaattttggaagaggacgctgggatccctaggtccctgacagggccactgtattttgggctggagacctggagtccttgaagggcatctggagggggcccaaacctgtctctacgttcctccatgaggcagtccaggctccctgtgcgagcttcgtgtcggtgctcagattccccttggtggtgcatgtgggtggctcatccctgagcccctgttctccccttgtgtctttcagtgaactcgtttgcccaggaggacccctggccttgagcagcataggtcagtggatcctactggggtcatgggccatggaccaggccacgtggggtcactgagggtcagctatcaggacaggagggattcctcagggagacaacctgaatccccactggtgagggattggttctccagaagggccgcctccttgggaatctgacccaaggaggacaccttccctgaagtgctacaggagtgacattggtccaggcaggaaagggttccattagtcccatgcaggtcagctcccagctgagacttggtgctagggtctggccttgaggactgcccaagccacatgaaggtggccccaggctgtgatttttggtgcgtgcttggagagggagtctgggcaccctccctgcacaggggcaggctgtgcgtctgccaggtctacagtggcgcctagcttcagagcaagcttccttggttggccttagctggttggtggccctggctcctacccaggggtcacaatgcagcccaggaagtgcagggaagccggcttggacagtggaggtgctccaggggcctgcggtagggcacagcctcggcatcttgcctgagcctagttactcgcctgtcctgtccttccagggtttggtggtggggagatacaagggttccccaggtccataactgtcctcgtttcacatggatcccatcacatgagtccacggatgtagagcatgtgtagccagcagcccctccccgctttcctgcatggaatcttaaggccctatttggacacctttccccgtccctccagatggtgagcacagaggaagaattgcgttaggccctttggccccggaccagtgtctgccagccacgtgctcagcctcccgtgcgctaaagctcaggtccttcctgtcatcctggtatcctgcactgaggtgtggtgagtccatccaggtccctctggatgtgtgagtggggatgggggtgtcctgggttgggtcgatgatgagaaccttatattgtcctgaagagaggtgatgacttaaaaatcatgctcaataggattacgctgaggcccaacttaggtgagaattttgaaagaggatgctgggaatcacaaggtccccggcaggaccactgtattttaggcgggagacctcgaggccctgaagggcatatcatggaggggtacccaacccagtctgtgctcctccattaggcacaccaggcttcctgtgtgggcttggtgtctgcactcagcttccccgggggtgggacacattggtggctccttcctgagtcgcattctcctctgtgtctttcagtgagctcttccccccagcaggccccctgggattgactggcaaaggtgagtggatactgctcgtgtcatgggctgtgagccaagctgcgtggggtccccaagggtcagccctcgggtcacctgggtttcctcaggagctgatctgaatcctgactggggatgtgttctccaggagggcagcttccttgggaatctgacacaaggaggaggccttctctggagccctgcaggggtggtggtggtccaggcaggaaagggtttcctcagctccacacaggacagtggagctgggcagtgctcagctcagacttggtgctcaggtcaggcctctaggatggccaggccacatgacgggggccacaagggctccagggcaccacagacatctcatgggggctctccaaccctggagaagggtgggcaatttggcccattgggtcgggtcatggagcttcaaggattgcaccaaacccatatccctcaatgggaccgaccctattaagcaatgggccatcccagtggcacctctttgagccatgtggtgggtggcgctgtttctctgaggttgggtcaagactagctccggccagtgcctgatggtggtgcagtccagtcctgggactcgtgggctttgggccaagggtgcagcccgtgtcctactggggatcaccccttccttatgagggagtggtgggaagggtatcctcctgaggtaggaaggcccgctgtggaaggaactttcctggaaatttgcagtccagactgcttctgagccatgaggtcatctccggggtggcggggtcttgggcccaaggaaaggagaagacaccatatgtctcccgattggttgagtatggctccactctgtgtgtgggaggtgttgtgtggggcatggattgggacccaccagagaaagctcgtggcactggaaccccaagctgcaatttccagtgcaccttgggaaggggactgggtgctcaccctccatgcacagggcaggctgtgcagctgccaagttggcagtggtgcgtggcatccgggccagcgtccttggttcgctgtgagctggttggtgtccttgacgcctgcccaggggtcccagtgctgcttggggtcatgaggggagccagcgtgggcaagggaggcctgcagtagggcacagcccgggggtcttgcctgagcccaggatcctgccggccctgtccttccatggttcggtggctgggagggcaaagggtcccccacgtctgagacacatcagtgtttcacatggatctcatcacatgggtccatagagagagagcaagcgtgagctgacaccccccacccccttccctgtatagaggtctgagcccctggttggacacatgtcttcctcctgtccccccagatggtgtctgtggaggaagacttgccattgggttgctggccccaggccagtggttgtcatccaggtgcccagccttggtgcactgaagctcaggcccttcctggtgctctggtctcctgcactgagctgtggtgagcacatccgggtcccactggatgggtgtgtgtggtggggggtgccctgggttgggtcgatgatgagaaccttatattgtctgaagagaggtgatgacttaaaaatcatgctcaataggattacgctgaggcccagcctaggtgagaattttggaagaggatgctgggaattacaagttccctgtgaagtccactgtattttgagctagagacctggaggctctgagggcatctggagggtgcccaaccctgtctctgcactcctccatgaggcagcccaggctcactctgtgggcttggtgtcggcgctcctgttacccaagggtggggtactttggcatctcctccctgagcccccattctcccctgtgtctttcagtgacctcttttgcccggcagaccccctggcattgaccagcataggtgagtggatcctgctggggtcatgggtcatgagccaggctgtgtggggttgccgagcatcagcctttggctgcaagggtttcctcaggaactgacccgaatgcccacctgggatgggttctccaggagggcagcttccttaggaatcggacccaaggaggataccttccatgaagccctgcaggggttgtggtggtccaggcagtaaagggtttcctcagccccatgcagggcagcacccagctgaaactcggtgcttaagtcaggcctctaggatggcccgtccacatgaggggaaccacaagggcactggggcgccaagggggtcttatgggggctctccgaccttggagaggtatgtgtgattcggcccatgaggtcaggttttggattttcaaggatctctccaaacccatggccctgaatgggaccgaccctattaagctatgggccatcccagtggtgcctctttgagccaagtgtggggtggcactgtttccatgaggttgggtcaagactagctctggtgaccccatgatggtgctgcagtctggccctgggactcgtgggctttgggccaagggtatagcccatgtcccaccaggggccacaccttccttgtgggcaagtggcggacagggtgtcctcctgaggtgagaaggcctgctgtggaaggacctgtccaggctgcttccaagctatggggtcacctacagggtggtggggtcaaggaaaggagaagacaccatgtgtctcccgattggctgagtgtggccccactctgtgtgtgggaggtgttgtgtgaggcatggatggggacatatcagagaacacacgaggccctgggtccccaggctgcaatttccggtgtggtgtggagcagggcctgggtgcttgccctccacacacaggggcaggctgtgctactgccagattggcagcagtacgtggcatccaggccagcctccttggttggccgtgagacggtaggtggccctggctgacacccaggggccagtacagccctggggtcatgtgaggcaactggagtgggtagtggaggtgctcaaggtgcctgcagtagggcatagccagggcgtcttgcctgagcccagtgacctacctgccctgtccttccagggttcagtggtgcagagggccaaagttcccctgtgtccatgacacatcagtgtttcacatggatcccatcacatgggtccatggtgggagagcaatcgtgagctagcatcccccacccccttcctgcatggaggcgtgaggttccatttggacacatgtccacctcctgtcccccagatagtgagactggaagaaaactttcattgggcccgctgtcccggggtgagtggtcatcagtcaggtgcccagcccttggtgtggtgaagctcaggctcttcctggcgccctggtctcctgcacggagctgcggtgagcacatccgggtcccgatggatgcatgcgtggggatggagggcgtgccctgagttgggtcaatgatgagaaccttatattgtcctgaagagaggtgatgacttaaaaatcatgctcaataggattacgctgaggcccagcttaggtgagaattctggaagaggatgctgagatccgaagtcccctggaagggccactgtattttgggctggagtccttgaggccctgaaggacaccttcggggtgcccaacccagtctctgcactcctctgtgtggcagccaaggctccttgtgcaggcttggtgttggcattctggttccctgggggtggagcacatcgacggctcctccctgagcccccgttcttctctgtgtctttcagtgagctcttctacccaggcgggcccctgcccttgagcggcataggtgagtggatcttgctggggtcacgggccaagagccaggccacggggggtcgctgagggtcacctttcaggccacgagggtttccttagggagctgacctgaatccccaccagagatggatggtttctccggaagggcagcttccttgttaattgatcccaagaaggacgccttccctgaaaccctgcaggggtaatggaggcccaggcagcagagagttccttcaacccaatacagtgcagcagcttgttgccttgatgctccccctccctggagaaaggtgggcatagggcccgtggagttgagttgcagagatttaaggatcgcacaggacttattgacctaaatgggactgaccctgttgagcaacgtgcacttggtgcatgggtcaggtgtggagcactgcccaggccacatgaggggtccactgggtctctgggggccacgggtgttatgcaggagctctccgtccccaaggcttgcaggggggtaggatgtcggtgatcgagcttatgcagtcaggccgtgaagattcaaggattgggcccaacccatggccctgatgggaccgaccctgttgagcaatgggctatcccactggtgcctccttgagcctggtgggggcagtgcggcctcagtgggcttggatcaaggctgagctctggccagcacctggtgtttggccctgggaatcgtgggctttgggccaagggttcagcctgtgtcccactggagttcatccctaccggaagtggagtggatggaagggtggcatcctgtggtggaagacccaccgttaagggtcctgtcctggcaatttgatgcccaggctacttctgagccatggagtcacctccagggtagcagggtcttgagccaaaggaaagttgaggacatcatgtgtcctctgattggccgagcgtggcccagctctgtgtttaggaggtgtgcggtgcatgaatggggacccaccagagaaggcatgtggccctggggccccaggatgtgatttctggtgtgtgcttataaagggtgcctggatgggttcatttaatgcccaggggcaggccatgtgactgccaggtctgcagtggtacgtggcatccaggccagcctccttgatttgctgtgagctatttggtgcccatggccctgcccagtggtcctgatgcagcccagattcgagcaggggatttggcgtgggcagtggaggtgctccagggtcctgcactagggtgcagcctgggcgttttgctcgaaccctgtgaccctcctgccccgtccttccagggttcagtggccaagggttcctcgcgtaaatgaccatcactgttttacatggatctcatctcatgagtccatggagggagagcatgtgtgagccagcaccccctgcccactttcctgcatggaggcatgaggccttgtttggacacctgtcccccacccttccagatggtgaccccagaggaagacttgcgttgggcccactggctctgggctcagcccctggtgagctgaagctcaggcccttcctggcaccctggtctgctgcactgagctgcggtgagcctatctgggtcccactggatgcatgggttgcggggcagtggagggtgatgccctgggttgggtcgatgatgagaaccttatattgtcctgaagagaggtgatgacttaaaaatcatgctcaataggattacgctgaggcccagcctaggtgagaattttggaagaaggtgctgggatccggagttccctggaatgaccaatgtattttgggctggagaccttgaggccctgaacagcagcatctcgtgggggcccaaccccttctccgtgctcctctgtgaggcagcccaggctccctgtgtgggcttggtgttagtgctccggttctgtgaacccccattctccccttgtgtctttcagtgagctcttccacccaggtgcaaccccctggcattgaccagcataggtgagtggtcccgctggggtcatgggtcatcagtcatgcagtgtggggtcaccaagagtcagcctttgagacaggagggtttccacaggcagctgacctgaatccacaccatggaagggtaggttggtcctccaagagggctgtttttttgggaatcggacccaaggatgatatctttcctgcagccctgcagtgatgacggtggtccaggcaggaaaagtttccttcaatctcatgcagggcagctcccagctgagtctcagtgcactggtctggcctcgaggactgaccaggccacgtgaggggggccacaggggctttgggatgccatggggtcacacaagagctccccatccctggagaaaggtgggcatagagcccatggagttgagctgcagatatttaaggatcacacaggatttatagccctgaatgggaccgaccctgttgagcaatgtgccatccatcctatggtacctctttgggcctggatggggtgttgctgtttccctaggttttggtcaaggctgagctctggccagtgcctggtggtgctacagtccagccacggacttgttagctttaggccaagggatcagtccacgtcctgctggggatctccccttccctgtggctggaagtcaccccttccccattggcaagtgtgaggaagggtggcctcctgaggtggaaggcctgctgttgagggtcttgtccctggaatatgccacccacactgcttctgagccatagggtcacctccaggatagtgggtattgggccaaaggaaagaagtcaccatgtgtcccctgattagccaagtgtggccctgctctgtgtttaggaggtgtgtggggcatggatggggacccaccagagaaagcatgtggccctgggactccaggttgtgatttccagttcatgctgggatagggcacctggatgggtgcccacaatgcaccggggcaggctatgtgactgccagctttgcagcggcatctggcatccgggccagcctccttggttggccatgaactggttggtggccctggcctgtgcccagtagctctgtcgtaatcctggggtcatgcgagggagccggcatgggcagtggaggtgctcgtgggacctgcggtaggacacagccaggtcttcttgcccgagcccagtgacccacctgccctgtccttccagggttcagtggttgagagtacagggtgacttgtgtctgtgacaagccagtgttctgcatggatcccatcacgtggatccatggacggcaagcatccctgagccgccacaccccaccttctgcctccatggaggggtgaggttgtgtgtggacgcctgtcctactcctgtttccccaggtattgagcctggaggaagacttgaattggtcccaatggtcccaggccagcatccatcagctaggtgctgagcccctggtgcactgaagattgggcacttcctggcaccctggtgtgctgcaccgagctgtgatgagcacatccgggtcctgctggatgcatgcgccgggaaggacgtgccctgagttgggtcgatgatgagaaccttatattatcctgaagagaggtgatgacttaaaaatcatgctcaataggattacgctgaggcccagtctaggtgagagttttggaagaggatgctgggatcctgaggtcccctggtagagccaattgtattttgggctggagacctggaagccctgaagggcatctgggaggcccaaccctgtctctgtgctcctccatgaggcagccctggctccccatgtaggcttggtgatggccttcctgttccctgggggtggggcacatgggtagctcctccctgacccccattctctcctgtgtctttcagtgagctcttccccacaggtgggccccctggcattgactagcatcggtgagtggatcctgctggggtcgtgggccgtgcaccaggctgcatggggtcaccaagtattagccttcaggacaggagggtttcctcagggagtcgaccttaatcctcacctgtggagagatgggtttgtcctctaggagggcagcttcctgggaaatcagacccaagacgatgccttccctgaagccctgcaggggtgacggtggtccagtctggaaagggttccttcagtctcatgcagggcagctcccagctgacacttggtgtgagagtctgtccttgaggactgcccaggacaaatgagtgggacaacagaggctcccggataccacagggatcactcaggggctctccgtccctggaaatgggtgggcgatcgggcccatggggtggggctgcggagattcaaggatcgtgccctgctcatggccctgaatgcaaatgaccctgttgagcaatgggtcacaccagtagctcctttttgagcctggtgggtggcggctcagcttcaactggttgggtcaaggctgagccatgactggtgctttgtggtgccgcaggccaaccctgggactcatgggctttgggtcaagggtgcagcccgcctgctgctgggggtcaccccttcttcgaggtcagtggcgggaagggtcacgtcccgaggttggaaagccccctcatgagggacctgtcctgggaatttgttgcccaggctgcttctgagccatgtggtcacttccgggtggcggggtcttgggcccaaggaaaggagagggcaccatgtggctcctgattggctcagtgtggcccagctctgtgtttgacaggggtctggggtgtggatgaggacccaccagacaaagcacgtggccctgggcccaggctgtgatttctggtgcgtgcttggagaaggatcctgggcaggcattctctccaaacaggggcaggttgtgggactgccagattggcagcagtgcctggcatccaggccagcatccttggttggctgtgagctggttggtgaccttggaccctgcccagggtttccgttgtggtccagagtcatgcagtggggccagtgtgagcagtggaggtgctccaggggcctgctgtatggcacagccagggcatcttacccaagccctcctgcactggtctcctgcactgagctgtggtgagcccatctgggttcctgtgatgcctgtgcggggagggggttgccctgggttgggtcgatgatgagaaacttatattgtctgaagagaggtgatgacttaaaaatcatgctcaataggattacgctgaggcccagcctaggtgagaattttggaagaggatgctgggaattatgagttccctggcagaaccactgtattttgggctggagacctggaggctctgagggcatctggagggtgcccaaccctgtctctgcgctcctccgtgaggcagcccaggctcactatgtgggcttggtgttggcactcctgttacccgggggtggggcattttggcatctcctttctgagcccccaatctcccctgtgtctttcagtgagctcttctgcccagcagcctccctggcagtgaccagcataggtgagtggatcctgctggggtaatggcccatgagccaggctgtgtggggtcaccaagcatcagccttcagccataagagtttcctcaggagctgacccgaatgcccacctgggatgggttctccagaagagtggcttccttggaaatcatacccaaggaagataccttccctgaagccctgcaggggttgcagtggtccaggcagtaaagggttttctcaacctcatgcagggcagtgccccactaagactcagtgctctggtcaggcctttaggatggccaggccacatgagaggggccacaagggctctggggcaccaaggggttcttgcaggggctcttcaaccttggagaggtgtgtgtaattcagcccatgaggtcaggctgtggattttcaaggattgcaccaaacccatggccctgaatgggacaaaccctaataagttatgggccatcccagtggtgcctctttgagccaagtgtggggtggcactgtttcctaagggtgagtcaagactagctctggctggcacctgatggtggtgcaatcctgccctgggattggtgggctttgggacatgggtacagcccatgtcccattggggtcaccccttcattgtggacaggtggcgggaagcatgtcctcctgaggtgggaaggcctgctgtggaagaccctgtctcagaaatttgctgtcttggctgcttctgagctatggcgtcacctctgtggtggcgggagtctcgggtgaatggatcctgctggggtcatgggccatgagccaggccggggtggggtccctgagcgtcacctttcgggtcatgagggtttcctaagggagccgacctgaatccccaccagggatgaatggtttctctgggaagcaggtttccttggaaatcagtcccaagaaggacaccttccctgaaaccttgcaggggtaacagaggtccaggcaagagagggttctttcaacccaacgcagtgcagatcctagctgagacttggtgcacaggtgagtcctggaggactgcccaggccacatgagggcatccacagggtctccgtggccaggagtcttatacgggagccctctgtccccgaggcttgcagaggggttgggtgtgggtgatctggcttacggagtcaggccgtgaacattcaagggtcgggaaccacccatggccctgaatgggaccgaccctgttgagcaatggccatcctggtggtggcaccttgagcctggtgggggtggcgctgcctcagtggggttgggtcaaggctgagctctgcctgtcaccttgtggttggccctgggaatcatgggctttgggccaagggtgcagcctgcgtcccgcttgaggtcactcctacctgaagtggagtggccggaagggtggcatcctgtggtgggagacccacggtcaaggatcctgtgctggcaatttgctgcgcagcctggttctgagtcatggggtcacctccagggtgacagggtctttgtcaaagggaaggagaggacattatgtggcccctgattggccaagcatggcccagctctgtgtttgggaggtatgcggtgcctgaatggggacccaccagagaaggcacatggccctggggccccaggatggtatttctggtgtgagcttataaagggtgcatggatgggtgcattccatgcccagtggcgggttatgtgactgccaggtctgcagtggcacatggggtccgggccagcctccttggtttgccatgagctggttggtggcccaggccctgcctagtggtctcattgcagcccagagtcatgtgggggagctggcgtgggcagtcgaggtgctccagggtcctacagtagggtgcagcctgggcgtcttgctggaatcccatgacccacctgccctatccttccagggttgagtggcagggagggccaagggttcctcgtgtgcatgactgtcactgttttacatggatctcatctcatgagtccatggtgggagagcatgtgtgagccagcacaccctacccactttgccctatggaggcacaaggccctgtttggacacctgtcccccacccctccagatgctgaccctggaggaagaattgcactgggcccactggccccgggaaaatgtccctcagccaggtgcttagcccctggtaatctgaagctcaggcccttcctgatgccctggtctcctgcactgagctgtggtgagcacatctgggtcccaatggatgcatgcatgcgttgtggggtggtggtgtcctgggttgggtcgatgatgagaaccttatatgttctgaagagaggtgatgacttaaaaatcatgctcaataggattacgctgaggcccagcctaggtgagaattttggaagaggatgctgggatttctaggtccctgtcatgggcactgtattttggactggagacctccgggccctgaacagcatctcgggggggactctaccctgtctccacattacatgtgaggcagcccaggctccctttgtgggcttggtgtctgcactctggttccctgtggtagggcagcttgctgggtccttcctgagcccctgttctccctttgtgtcttctgtctttcagtgagctcttcagcccaggtgggctccctgacactgatgcgcataggtgagtggattctgctggcatcatgggccatgagccaagctgcgtagggtcaccaaaggtcactctttaggccacgtgggtttcctcagggagccgacctgaatccccaccaggttgggacagtttctccaggaggctggcttccttgggaatcagacccaagacaatgccttccctgaagccttacaggggtaacagttgtccagacaggaaagggtcccctcagtcccattgaaggcagctcccagctgagactcagtgtgcgagtctggcctcaaggatggcccaggccacatgaaggaggccacaggggctctggggtgccacaggggtcacacgagagctctctttccctggagtggggtgctcgaatgagcccatggggtcaggctgcagagattcaaggatcgcatcccaaccgtggccctaaatgcgaccgaccatgttgagtaatgggccatctcagtggggcctctttgagcctggtggggggcggggctgtttccctgggtttgggtcaaggctgagctctggccagcgcctggtgatgctgcaggccagcccaggttcttgtgggcgttggtccattcggcagccctgtcctcctggaggtcaccccttgcctattggtgattggctggatcctgaggtggaaagacctgctgttgatggtcctgtcccaggaatttaccacccaggctgcttctgagccatggggtcacctccagggtggcggagtcttggggctaagaaaaaagaggacactatgtagcccacggttggccaagggtggcctgactctgtgtttgggacatgtgcggggcatggatagggacccgccagagaaagcacgtggcccggggactccaggcttcgatttcaggtgtggcttgcaaatagcacctaggcaggtgcccaccacgccctggggcaggctatgcaacttccatctccacagtggcgcatggcttctgggccattctccttggttggccatgagctgattggttcccctggcctgtgccctgtggtcccggagtggctctgggatcgtgtggggcagccagcatggacagtggagatgctatcaaggccttcagtagggtgcagcccaggtttcttgcctgaacccagtgacccacctaccctgtgttttcagggtttgctgacagggaaggccaaacgtgccccacgtccatgctaggtcagtgttcctcatggaccccatcacatgggtatcccttaccccttccccacatggaagtatgaggctctgtttggacacatgtcctcttcctgtccccccagatggtgagcctggaggaagacttgcattgggcccaatggacccaggccagtggccatcagccaggtgcccaccctggtgtgctgaagcgcgggacctacctgttgtcctggtttcctacactgagctgaggtgagcacatctgggtccctctggatgcatgcatggggcggggggtgccctggtttgggtcaatgatgagaaccttatattatcctgaagagaggtgatgacttaaaaatcatgctcaataggattacgctgaggcccagcctaggtgagaatttggaagaggatgctgggatcccaaagtcccagtaggggactttatttatttattttgggctggagccctggaggccctgaagggcatctggggggcccagccctgtctctgtgctcctccgtgaggcagcccagcctccctgtgtgggcttgctgttggtggtccagttccttggggcggggcacgtggacagctcctccttgagcccccctgctccacttgtgtctttcagtgagctcttcaacccaggcggggcaccctggcattcaccagcataggtgagtggatcctgctgccatcgtgggccatgggccaggctgggtagagtcactgagggtcagccttcgggacaggagagtttcctcagggagcgaacctgaatccccaccagggagggataggttggtcctccagaagggtggcttcctgagaaatcggacccaagggggacgccttccctggagccctgcagtgatgacggtggtccaggcaggagagggttccttcagtctcacacatagtagctcccagctgagtctaggtgttcgagtctggccttgaggactgcccaggccacctgaggggccaacagggactctgggacaccatgggggtcacataggagctctccattcatggagaaagatggatgatagggcccatggagtcgagctgtggagatttaaggattgcgcccaatgtatggccctgaatgggacagaccctgttgagtaatgagccattctatgggcctcatcgagccttgagcggggcggtgctgtttccctatgtttgagtcaaggctggactctggccggtgcctggtggtgctgaggtctggccatggactcgttggctttgggccaaggggtcagcctgctccccctggaagtccccccttccccgtggctggaagtcatcccttcccaaggggcaagtgtcgggaatggttgcctcctgaggttgcaaggcctgctatctagggtcttgtctttggaatatgctgcccatgctgcttctgagtcatggggtcacctccagggtagcggatcttgggcccagggacagaagatgccgtgtgtcccctgattagctgattgtagccctgctctgtgttcaggaggtgtgtggggcatggatgcagacccaccagagaaaactgtggcccttagaccccaggttgcaatttccattatgtgctgggatagggcatctgggtgggcacccactatgcacagagataggctatgtgactgccagggctgtagcggcatctgacatctaggccagcttccttggtttcctgcgaatgagttggtggccctggcctgtgcctagtagttctggggtgaccccgggtcgtgtgggggagccagcaggggcccagtgaccagcctgccctgtccttccagagttctgtggctaagagagcactgggtaccctgtgtccgtgatgggccagtgttccgcatgcaaacgatcacatgggtccatggagggcaagcatacttgaactgccacaccccaccttctgctcacatacaggagtgaggttgtgtttggacagctgtcctactcctgttcccctagactgtgaaatgggaggaagaattgtgttgggcccaatggccctgggccagtatccgtcagcctggtgtccagcccctggtgtgctgaagctcatgcccttcctggtgccctagtttcctgcactgagcttggtgagcccatttgggtactgctggatgcatgggtggggagggaggtgccctgggttgggtcgatgatgagaaccttatattgtcctgaagagaggtgatgacttaaaaatcattctcaaaaggattatgctgaggcccaccctaggtgacaattttggaagaggacactggaaatcaatgaggtccctggcagggccactataatttggggtggagacctggaagccctgcagggcacctcgtgggggcccaaccctgtctcttcactcccctgtgaggcagcccaagctccctctgtaggcttggtgtcggcactctgctttcctggaggcggggcattttggctgctccttcctgagcccctgttctcccctgtgtctttcagtgagctcttttgcccagaagactccctggcattgatcggcataggtgagtgtctcctgcttgggtcatgggccatgagccagaccatagggttgccgagggtcagcatttgagccatgagggtttcctcaggaggcgacctgaatccccacctgggatgggttctccaggagggcagcttccttgtgaatctgagccaagtaagatgccttctctgaagccctgcaggggtgccagttgtgcaggcaagaaagggttccctcagccccaggcagggcagcgcccagcagagactcggtggttgggttaggcctctaggatgaccaggccacatgaggggggccacaagggctctggggcacaacaggggcttcgcagggtctctgcgaccccaaagagtggtgggcgattcggcccatgggatcgggccccagattcaaagatcacaccacacccatggccctgaatggaaccgaccctgttaagcattggggcatcccaggggtgccactttgaacctggtgtggggtgccgctgtttgcctgaggttgggtcgagactagctccggccagcacctgatggtggtgcagtccggccctgagattagtgggctgtgggcccagggtgcagcctgtgtcccgctgggggtcacctcttccttgtgggcgagtggtggaagggcatcctcctgaagtgggaaggcccgctgtggaaggaactgtcctggaaatttgccatccaggctgcttctgagccatggggtcgcctccagagtggcagggtcttgggcccaaggaaaggagaggacactgtgtttccctcaattagctgagtgtggccctgctctctgtgtgggaggtgttgtgtggggcatggatagggacccaccagagacaacacatggccctcgggccccaggctgcaatttctcagtgcatgcttggagacggtcctgggcctcctccatgcccagggtcaggctgtgcaactgtcaggttagcggcggcatgtggtgtctgggcctgtctacttcgttgtccgtgagctgctggtggccctagccctttcccaggggttcaggtgcagccctggggttgtgtgggacagccagtgtgggcagtggagctgctctggaggcctgctttagggtgcagcctgggtgtcttgcccgagtgtagtgacccgcctgccgtgtcctcacggggttccctagcaggaagggccaagggtcccctgtgtctgtgacacgtgagtgtttcccatgggtcccatcaaatgggtccacggagggagagcatgagtgaactggtaccccccacccccaccctcttccccacctggaggcatgagcccctggttggacatatgtcctcctcctgtacccccagatggcagcgctggaggaggacttgtactggggccgctggccccacatcagtgtccgtcatcccggcgtccagcccctggtgtgctgaagctcaggcccttccttgtgccctagtctcctgcactgagcttggtgagcccattcggatactgctggatgcatgggtcgggagggaggtgccctgggttgggtcgatgatgagaaccttatattgtcctgaagagaggtgatgacttaaaaatcattctcaaaaggattatgctgaggcccggcctaggttagaattttggaagaggatgctgggatcctgaggtccccaggagagcccctttatttttggctggagacctggaggccctgaagggtatctggggggcccagccctgtccctatactcctctgtgaggcagcccaggctctctgtgtgggcttggtgttggcactctggttttctgggggcggttcaggttgctggttccttctgaaccattgttctccccttgattctttcagtgagctcttctgctcaggcgggtcccctggcattgaccagcataggtaagtggatcctgctgggttcatgggccatgagccagaccacatggagtgactgagggtcagccttcaggacaggaagatttcctcggggagccaacctgaatccccaccgtggagggatgtgttagtcctccaggagggtggcttcctagggaatctgaccccaggaggacacctttgctgaagccctgcaggggtgatggtggtccaggctggaaagttttccttcagtctcatgtggggcagctccctgctgacattccgtgcctgcgtctgaccttgaggactgcccgggccacatgagtggggcaacaagggctccagggtgccacggggattatgagtggggctctccatccccggagagaggtgggcaatcaggcccatgtggtcaggcttgtagggttcggtggtggggagagccaaggtttccctgggtccattaccgtcactgtttcacctggatcccatcacatgggtccatggagggagagcatgtgtgaacaggcaccccttgctccctttcccacatgagcccctggttggacatatgtcctcctcctgtccccccagatggtggccctggaggaggacttgtattggggccactggccccacgtcagtgttcgtcagcctggcatccagcccctggtgtgctgaagctcaggcccttcctgttgccctagtctcctgcactgagcttggtgagtccattcggggactgctggatgcatgggcgggtagggaggtgccctgggttgggtcgatgatgagaaccttatattgtcctgaagagaggtgatgacttaaaaatcattctcaaaaggattatgctgaggcccggcctaggttagaattttggaagaggattctcggatcctgagatccccagccaggccactgaatttttggctggagtccttgaggccctgaagggtgtctgagggctgctgaaacctgtctctgtgcttgtccgtgaggcaacccacattcgctgtgtggacttggtgttggccttcccgttctccggggatgggacatactgtcagcttgtccctgagtacccgttctcccctgtgtctttcagtgagctcttctgcccaggtggtccccctggtcttgatgggcataggtgagtacatcctgctggtgtcctggtccatgagccagggtgcgtacggttgccggaggtcacctttaggccatgtgggtttcctcagggagctgacctgaatccccactgggagggatggtttctccaggaggatgtcttccatagaaactggttccaagaaggatgccttccctgaagctgtgcaggggtgacgatggtccaggcaggaaagggtccattcaacccaatgcagtacagcttctagctgagactcggtgcacgggtgagggcttgaggactcccaggcaacatgaggggttccacaggatctccggaggccacaggtgttaagcaggaactctccatccttgaggcttgctgggggtggcgggatggcagcagggtgtgggtgatcgagtttatggattcaggccaagattcaagggtcaggccccacccattgccctgatgggaccaaccctgttgtgcaatgggctgtcccactggtgcctccttgagcctggtgtgggcagcgtggcttcaatggggttgggtcaaggctgagctctggcccgcacctggtggttggccctgggaattgtggactttgggccaagggtgcagcccgcctgcctctggaggtcatcctacccagaggtggagtggccggaagggtggcaggcatcctgtggtgaaaggcccactgttgagggtcctgtcccaccaatttgctgttcaggctgcttctaagccatgggttcacctccagagaggcgggatcttgagcccagggaaaggagagggcatcatgtgtcccctgattggctgagaatggggagagtgtttgggtggtatgtggtgcatgaatggggacccaccagagaaggcgcgtggccctgggccccaggatgcaatttccggcgtgcttatagagggcgtctgagtggacactctccatgcccaggcgcaggctatgtgactgccaggtctgcagcagtttgtggcatctgggctagcctccttgattgcttatgagctggttgatagccctggcctgtgccgaggggtcctggtgcggccctggggttgttcaggggaagccggcatgggcagtggaggtgctcttggggcctgcagtagggcacagcccaggtgttcttgcttgagcgcagtgaaccacctgccctttccttccagggttcggtagcagggagggccaagggtcccccacgtccatgacaggtcagcgttcctcctggatcccatcacatgggtacatgcagggagagcatgtgtgagccggcactccccactctcttccccgcattgcagggtgaggccctgtttggacccatcttccagctatctcaccagatggtgagcccagaggaagaccccgtggctctgggccagtgtgcgtcagccaggtccccagcccccagtgtgctgaagctcaggcccttcccaacgccctggtctcctgcactgaggtgtggtgagcacaaccaggtcccactggatgcatgcacagggagggatgtgccctaggttgggtcgatgatgagaaccttatattgtcctgaagagaggtgatgacttaaaaatcatgctcaataggattatgctgaggcccagtctaggttaaaattctggaagaggatgctgggatcccaagttcacaggcagggccactgtattttggactagagaactcgaggccctaaagggcatcttgagggggtccaacctgtctctgtgctcctccatgaggcagccctggctccctgtgtggccttggtgttggtgctctggttcccaggcgtggcatgtgggcacctccttccagagcccccattctcccctgtctctttcagtgagctcttccgcccatttgggccctctgacattgaccggcataggtgagtggatcctctttgggtcatgggtcatgagcgaggcaaagtggggtcaccatgcatctgccttcgggccatgagagtttcctaaaagtgtggacctgaattcccaccggggatgagttatccagaagggccacttccttgggaatcggacccaagaaggacgcctgtcctgaagcccagcaggggtggtggtggtccaggcaggaaagggttcattcagcaccaagcaggcagctcccatctgagacttggtgcatcggtcaggccttgaggactgcccaggacacatgaggtggccacaggggctccggggcactacagggggtctgcagagaggggtaggcgattgggtccgtgggggtcatgccgcggagtttcaaggacacccatggccctgaatgggactgaccctgttgagtaatgggccatcccaatggcacctccttgagtctggcggtgggtggtgctgtttccctggggctaggtcaaggctgagctctggctagtgcctgtggtgctgcaggctggccctagaactcatgggctttgggccatggggacagcttgtgtcatgcttggggtcaccccttcccggaggttgaatggcgggagtggtggcttcctaaggtgggaagtcctgctattgagcaacctgtcctgggaatttgccacccaggctgcttctgagacatgaggtcacctccagagtggcagcatcttgggtccaaggaaagaggagcataacatgtgtccccagattggttgagtgtggcctagctctgtgtttgggaggtgtgcagggtgtggatggggatgtatcaaagaaagtacatagccctggagccccaggctgtgatttccagtgtgtgcttggagaggggcaggagcaggctctcgactgccaggtctgcagcagcgcgtggcatccgggcaagccttctggttggccatgtgctggttggtggccctggcctgtgcccagtggtctcagggtagacctggcattgtgcagggcagccagcagggcagtggaggtgctctcaggacctgcagtagggcgcagcctggactttttgtgtgagaccagtgacccacctgcactgtccttccagggttgggtggctgggagggccaagggtggtccatgtttgtctccgtgacacatcagtgctctgcatggatcctatcacatggatatcccctacccaccttccccacatggaagcatgaggccttacttggacatgtgtcctcctgtcctagatggtgagctcggaggaagacttgcattgggcccaatggagctgggccagtttctgtcagccaggtccccagctcctgatgcactgaagctcaggcccttcctggagccctggtctcctgccctgagctgtggtgagcccatctgggtcccactggatgcatgcatgggagggggttgccctcggttgggtcgatgatgagaaccttatattttctgaagagaggtgatgacttaaaaatcatgctcaataggattacgctgaggcccaacctaggggagaattttggaagaggacgctgggatcctgaggtccgtggcagggccaccgtattttgggctggagacctcaaggccctgaagggcatcttggcagcccccagccctgtctctgcactcctccgtgaggcagcccaggctccctgtgtgggcttggtgtcagagtcccattccccaggggcggggcaggttggcggctcctccctgagtcccctttctcccttgtgtctttgagtgacttcttctgcccaggtgggccccctggcgttgaccagcataggtgagtggaacctgctggtgtcatgggccatgagccaggccatgtggggactccaggtcagccttcaggacaggagagtttcctcagggagcaggggaatccccactggggagggatgggttctcccagagggccactttcttttgaatcggacccatggaggacatcttctctgaagacctgcagaagtgatgatgtttcaagcagcaaagggttttttcagcccctgcagggcaggcagctcccagatgagattctgtgcatgggtcaggcctcaagaactgcccaggccacatgcggggtgccacacaggctgtgaggcaccacaggggtcatgcaggagctctcggtcttcaggcttgttgtgggggtggtgacagagtgatcaggcccacagggtcaggctgcagtgtttcaaggatcgcgcccacctgtggccctgaatgggaccgatgctgttgagcaatgagccatcccagtggctccacattgagcctggtgggggcgccactgtttcagtggggatgggtgaagcttgagctctggccagcacctgatggtgttgcaggctggcccagggacttgtgggctttgggccaggtcggcagcctgagttctgctgggggtcacatctttcctgagtttcagtgtcaggatgcatggcctccttaggtgggaaggcctgctgtggagggtcctgtcctgggaatttgctgcccaggctgcttctgagccatggcgtcacctccaggtggtggggtcttgggcccaaggagcagagaagacaccatgtggcccctgattggtcgagtatggcctggctctgagtttgggaggtgtgcagggcatggatggggacccaccagagaaagcacgggccaatgaagccccaggctgcgatttctgatgcgcacttggagagggcgcctggttgggcgcccaccatgcccaagggtaggctatgcaactaccaggtctgcggcagtgcctggcatcaggaccagcctcctttgttggctgtgagctggttggtggccctagcccgtgtccagtgatctctgtgcagccctggggtcatgtggagcagccagtgtaggcaggggaggttatcttgaggtgtgcagtaggcacatcccaggcatcttgcccgagcccagtgacctccctgccctgtccttccagggttcggtggcggggaggcccaagggtaccctgtgtccatgacaggtcagtatttcatgtgaatcccatcacatgggccctcctcctgtccccccagatggtgagcctggaggaagacttgcactgggccttctgtgcgccggccagaggccatcaaccaggtgcccaggtccttttgtactgaagcttgggcccttcctggcaccctggtctccttcatggagctggtgagcccatccgggttcttctggatgtatgcatggggagcggggtgcactgggttgggtcaatgatgagaaccttatattgtcctgaagagaggtgatgacttaaaaatcatgctcaataggattacgctgagtcccagcctaggtgacaattttggaagtggacactgagaatcacaaggaccctggcagggccactgtattttgggctggagacctggaggccctcaagggcctctcacagggacccaaccctgtctctgcactcctccgtgaagcacagcaggctccctgtgcggacttggtgttggcactgtttcccaggggcagggcacattggtggcttttccctgagtccccattcttgccttgtgtctttcagtgagctcttcagctcagaagggccccttcaccttgattagcctaggtgagtgcatcctgctggtgtcatgggccatgagtcaggccgcgtggggtcaccaagggtcagtctttaggacaggagggtttcctcagggagccaacctgtatttccaccggggagggatggtttctacaggagggcggcttccttgggaactggacccaagatgttgccttcctgaagccctgcagggatgacagtggtccaggcagcaaagacttccttcagccccgtgcaggagagctcccagctgagactcagtgcatgtgtcaggcctcgaggattgccgaggccacatgatgggggccacagggcctccggggcaccacgggggtcatgcaagagttctctttccctggagaggggtgcttgaatgagcctatgggattgggccgtggagattcaaggattgtacccaactatgtcccaaaatgggactgaccctgttgagctatggaccatcccatggtgcctctttgagcttggtggggggcagtgctgtttccctgggtttgggtcaaggctgagctctggccagtgcctggtgaggctgtgggccggacctgggactcgtgagctttaggccaagtcgacagcttgtgtcctgctggaggtcaccccttccccatgggtgagtggctggaagagtggaatgtgcggtgggaaggcccgctgttgatggtcctatcctgagaatttgctgcccagactctctgtgccatggggtcatgtccagggtggcagggtcttgggcctagggaaaggaaaggacaccatgtggcccaggattggccaagggtggcccggatctgtgtttgggacatgtgtggggcatggatggggacccaccagagaaagcacatggccctggtactccaggctgtgatttcaggtgtggcttggagagagtgcctgggcaggtgcccaccatgcccagcggcaggctatgcaacttccatgtccacggtggcacatggcttctgggccaggctcctcggttggccatgagcatgtcggtgaccctgtcccatgctcagtggtcctggggcagccctgggatcgtgtgaaggagaagtcagagggggcactggatgtgccctcaaggtctgcaatagcatgaagaccaggggtcttgcccaagcccagtgatccacctgccctgttttttcagggtttggtgatggggagggccgagagtgccctgtatccgtgacaggtcagtgttccacatggatcccatcacatgggtatcccttaccccattccccacctggaggtatgaggccctgtttggacacatgtcctcctcctgtccatccagatggtgagcctgaaggaagacttgcatcaggaccaatggaccctggcaagtgtccgtcagccaggtgctcagcccctggtgcactgaagctcaggcccttcctggccccttgatctcctgcactgagctgtggtgagcacatccgggtcccgctggatgtatgtgtgggcagggggggtgccctgggttgggtcaatgatgagaaccctatattgtgttgaagagaggtgatgacttaaaattaccatgctcaatgattacgctgaggcccaacctaggtgagaaatttggaggaggatgctgggatcccgagatttccggcagggccactgtattttgggctggagccctggaggccctgaaaggtatctggaggaggcccaactctgtctctgcactcctctgtgaggcagcccaggctccctgtgcgggcttggtgttggcctttctgttccccagtgaagtggcacgtgggtggctcctccctgagccccagttctccccttgtgtctttcagtgagctcttctgccaagggggggcctcctggcattgaccaacataggtgagtggatcctgctggcatcatgggcatgggttcactgagggtcagacttcaggccatgagggtttcctcagggagctgaccccaattcccatcagggagggatggtttctccaggagggcggcttccttgggaatcttacctgaggaggatgccttccctgaagatctgcaggaatgacaatggtccagatagcaaagggttccttcagccccatgcaggacatcgcccagttgagacttggtgtgcaggtcaggccttgaggactgcccaggccacatgaggcgggccagaagggctccagggtgccacgggtttcacttgggagctctcggtccccgggcatgttcctggggggggtggtgatggggtcgggccatggaggttcaaggatctcatcccacctgtgaccctgaatggggctgatcctgttgaacaatgggccatcccagtggcacgtattgagcctggtcaggggtggtgcagtttcaatggggttgggtcaaggttgagatctggccagctcctggtggtgcttcaggccagtcctgtgacccatgggctttgggctaagggggcatcccatgtcccatgggggtcacctgttctccatgtttgagtggcagtaacagtggcattctgaggtgggaaggtccactgtctagggtgttgtaccgggaatttgccaccccgccttcttagccaaggggtcacctccagggtctcgggatcttgggcccaaggaaacgagaagataccatgtggcccttgattggccgagtgtggcccagctctgtgtttgagaggtgtgggatatgaatggggtcccaccagtgaaagctcatggcccaggtccccaggctgtgatttttagtgcacacttggggagggctcctcagtgggtgcccaccacgcccagaggcaggctatgtgactgccaggtctgcaacggtgcatagcttccaggctaccctccttggttggctgggagcgggttggtggccatggcccatgcccagtggtcacagggcaaccctgggatcatgcaggggagctggtgagggcagtggaggtgctctccggaacggaagtatggctcagcccaggtatctggcccaaacccaatgaccagcctgccttgtttctcagggtttggtgatggggagggccaagggtgccctgcatctgtgatgggtctgttccacatagaacccattacaggggatcccttctccacatggagatgtgaggccctatttggacacatatcctcctcctgtccccccagatggtgagcctggaggaagatttgcattgggcccaatggccctgggccagtgtctgtcagccagtttcccagcccctggtgcactgaagctcaggcctttcctggcatcctggcctcctgcactgagctgtggtgagtatatcatggtcctgctggatgcatgtgcagggagggaaggtgccttgggttcagtcagtgtcgagaaccttatattgttctgaagagaggtggtgacttaaaaatcatgctcaataggattacgctgaggcccagcctagttgagaattttggaaggggacagtaggatcccgaagtccctggcagggcccttatattttaggctggagacttcaaggccctgaagggcacctggaggtggctcaacctgtctctgtgctcctccatgaggcagtccaggctccctctgtgggctttctgttggcactctggttccctgggccagggaacgttggtggctcctccctgagcccctgttctccccttgtgtctttcagtgagtgcttctgcccaggcaggccacttggcattgaccggtataggtgagtggatcctgctggggtcatgggtcatgagcaaggccacatgggtcgccgagggtcagccttacagccataagggttttctcagggagcccacctgaattcccaccggggaggcataggttctccaggagggcggcgttttggggaatcagacccaagggggacaccttccctgaagccctgcaagggtgatggtggtccaggcaggaaagggtttttttcagccccacacaaggcagctcctagctgagaatcggtgcttgggtcagacctcaaggattgcccaggccacatgagggcgactgagagcctccggggcaccacaggggtcacgtgggagctctcggtgcctggcgtgtgatgcacaaatggacctcttgggtttgttcatggagattcaaggatcgcaccccaccatgcccctgaatgggatggtccctcttgagaaatgggccatcccagtgggtctcctggagcctggttggggggtggcattgtttccctggggttgggtgaaggcagagttctggccggcacctggtggtgctgcaggtcagcactgggacccgtgggcgttgggccaaaggagagcccgaatcccactgggggtcaccctttttccaacatcaaatgtctggaagggtggcctcctgaggtgggaagtcctgctgttgagggacatgtcctgggaatttgtcactcaagcttcttctgagctttggtgtcacatccagggtggcagggtcttgggtccaagcaaagcagagggcaccatgtgtctcctgattggccaagtgttgctggctctgtgtgggaggtgtgcagagtatggatggggacccacgagagaaagcacgtagcactgcaactccaggctatgatttctgttgcatgcttggagagggtgcctggacaagcgtgccatgcccaggggcaggctgggcaactaccaggtcttcagcggagtgtgacatctgggccagcctccttggttggccgtgacctggttggtggcccggctctgtgcctactggccccagggcagccctgggatcatgcaggggagccattttgaacagtggaggtgctcttggggcctgtagtatggcacagcctaggtgttttgctcaagcccagtgacccacctgccctgtcctctccgggatcggtggaagggagggccaaaggtgctccgtgtacttgatgagtcagtatttcacattgaactcatcacatgtgtccatggagggtgagcaagggtgagatggcactgctgacccccttccccacgtagaggtcagtttggacacttgtcttcctcctgtctccccacatggcgaccccagaggaaaacttgtgttgggcccgctgtcactgggccaatgtcagtcagccaggtgcccagcccctggtgcgctgaagcttgggcccttctggcacccttggctcctgcactgagctgtggtgagcccatctgggtcctgctggatgcatgtgcagggagggggatacctgggttaggtcgattatgagaaccttatattgtcctgaagagaggtgatgacttaaaaatcatgcccaataggattacgctgaggcccagcctaggtgagagttttggaagaggatgctgggattctgaggtccctgacagagtaaatgtattttgggctggagaccttgaggccctgaagggcatctggtgggcccacccctatctctgtgctcctccgtgaggcagcccaggctccctgtgctggcttggtatctgggctccggatccctggttatggggcatgttggagtctccttcctgagtccccgttctcccctgtgtcttttggtgagctcttctgcccaagtggtccccgcggccttgagcggcataggtgagtgcatcctgtttcggtcatgggccatgagtgatgcagcatggggtcctcgacattcagccttcgggccactagggttttctcaggctgccaacctactccccaccagggagcaatggtttctccaggagggccacttccttgggaatctgacccaaggagcacatctttcctgaagccctgcaggggtgacagtggtccaggcagcaaagggttccttcagcccaatgtagggcagctcccagctgaaactcggtggacagctcaggcctggagtactgtccagggcacatggggaggaggggcacagggaatgtggcgcaccctagaggttacactggagttctctctccctggagaggggtgagtgattgggcccacacagtcaggctgtgaagattcaaggaatgctccacacccatggccttgaatgggaccaaccctgttgagcagtgggccatcttatggtacctccttgagtctggtgagggatggcactgtttcagtgaggttgggtcaagactgagctctggctggcacctggtgctgctgcaggccctgggacttgggggccttcagtcaagggggcagctctgatcctgctggggacaaaccttccttgaggtccagtggtgaagagtgtcctcctaaggtgggaaggcctgctgtcaagggaatttgccacccaggctgcttctgagccttggggtcacctcagggtggcagggtcttgtgcccaaggaaaggagaagacaccatctggttcctgattggctgagtgtagccgggctctgtgtgtcggagttgggcagggcatggatggggacccaccagagaaagtgtggcccaggggccccccaggcttggagagggcaccagggccggtgcccacaatgctcaggtgctggctctgggagggccaggtctgcagcggcttttggcatctggccaaccaccttggttggccaggagctggttgatggccctgtcctgtgtcctgtgccctgtgccctgtgtccctggtatggccctggggtcatgtgtgggagctggcctgagcagtggaggtgctcttggggcctgcagtagggtacagcctaggcatcttgcctgagccagcactgtcttttgctttccctgtctttccagggtttggtggcagagagggcaaaggatgccccacatctgtgttgggtcagtgttcagcatggatcccatcacatgggtatcccttagccccttccctgcattgatatgtgaggccctggttggacacatgtcctccttctgtccctctagatggtgagcctggaggaagatgtgtgggacccgcaggccgagggccagtgtctctcagccaggtgctcagcccccagtgggctgaaactctgacccttcctggcaccctgctctcctgcactgtgctgtggtgagcacatccgggttccactggatgtttgtgcagggagggggttccctgggttgggtcaatgatgagaacagggccacatgaggggggccagaggggctacagagtgccatggggtaacaagggagctcttggtccctggagtgtggtgtgtgaatgggcccatggggttgggtagcagagattcaaggatcctgctctacccatggccctgaatgtgaccatcgctgttgagcaatgggccatcccagtgggtctcctggggcctggttggggggcggagttgtttccctgggattgggtcaaggttgactctggctggcacctggtggtgttgcaggtcagccctgggactcatgggctttgggccagggacagcccgcatcccgctgggggtcacccaagtgttgtgaagggtggcctcctgagttgggaaggcccgctattgaggcatctgtactgggaatttgttgctcacgctgcatgggagccatggtatcacctccagggtggcagtcttgggaccaagcaaaggagggggcagcatgagactccggattggctatgtgtgactggctatgtgtcttggaggtatgtggagtatggatggggacccaccagagaaaacaagtgaccctgaggccccatgctgtcttttctggtgcctgcatggagagggtgcctgtacgcatgcccaccatgcccaggggcaggctgtgccactgtcaggtctgcagtagcatgtggcatctgggccagcctccttggttggctgtgacctggctggtggcccggacctctgcccagtggtcccagggcagccctagggtcatgcggaggagcagttttggccagtggaggtgcccttgggtcctgcagtcgtgcataccctgggcgttttgcctgagcccagtgacctacctgccttgtccttcccgggttcggtggcagggagagacacttgcataggtgatgagtcagtatttcgcatggatctcatcacatgtgtccatggagggggagcaagcgtgagctggcacccaacacccctttctccacatggagggtggtcacatgttctccacctgttcccctagatggtgagacttctgttgggcttgcttttcctgggccagtgtccatcagccaggtgctcagccatcggtgcgctgaagctccagcccttcctggtgccctgatctcctgcactgagctgtgatgagtacatccgggttccactggatgcatgtgcgggaaggggggtgccctgggttgggtcagtgatgagaaccttatattgtcctgaagagaggtgatgacttaaaaatcatgctcaataggattacgctgaggcccagcctgggggagaattttggaaaaggatgctgggatcccagggtccccaacagggccactgtattttggacctgggacctggtggctctgaagggcatctggaggtggcccaacctgtctctgcactctagtttccctgtgtgggcttggtgtcggtgctccagttccctgggggcagggaatgttgatggctccttcctgagtccctgttctcgcctttgtctttcagtgagctctttcacctaggagggccccttggcattgactggcataggtgagtggatcctgctggtgttatggatcatgagccagaccatatggggtccccaaggatcagcctttgggccacaagggttttctcagggagctgacctgaatttccacctgagacggaaaggttctcctggaaggcaggctttttggaatcggacccaaggaggacaccttctctgaagccctgaaggggtgatggtggtccaggcaggaaagggttccttctgcctaacataggacagtgcctagttgagactcggtgctgcagtaaggccttgaggactgcccaggctacatgaggggggccagaggggctacggggcaccacagggttaatggtgacctcttggtccccagagtgtggtgcgtgaatggacccatggtgttgggttgtggagattcaaggatagtgccccacctatggccctgaatgcaactgtccctgtttagcaatgggccatctcagtgggtctcctggagcctggtggggggcagagttgtttccttgtgactgggttaaggtagagctctggccagcacctggtggtgtggcaggtcagccctgggactcttgggcttttgaccaaggggcagcctgtatcccgctgggggtcatcctatctctgaggtcaagtgtcgtgaagggtggcctcctgaagtgggaaggctcgctgtcgagggacctgtcctaggattttattgctcaggctgcttctgagccatggtgtcacctctagggtgatggggtcttgggaacaagcaaaggggagggcaccatgttgctccggattgggcaagtgtggcccagctctgtgtgtgtgaggtgtgcagaacatggatggtgacccaccagagaaagcacatggccctgtagctctaggttgtgatttccgtgcacacttggagacagcatcttgatgtgtgcccaacacgcccaggggcagactatgcgatagccaggtctgcagcggtgtgtggcatctgggccagccacctttgttggccatgagctggctcatggccctgacccatgcccactggtgtcagggggccctggcgtcgtgtgaggagccatctgtggcagtggaggtagactcagggcctgcagtatggcgcaacccatgcattttgcctgagctcagtgacctacctgccctgttcctccagggtttggtggcagggggagccaagggtgccccacattggtgacgagttagtacttcacatggatctcataacatgtgtccgtggagggcaagcaaatgtgagcccgcacccactactgccttccccacatggaggtcagtttggacacatatcatcctgctgtcccccaaatggtgagaccgaagaagacttgccctgggccctctgttcttgggccagtgtcagtcagccaggtgcccagctctaagtgcgctgaagcttgggcctttcctggaatgctcggctcccgcactgagccagggtgagcacatccgggtactgctggatgcatgtgtggggcaggggtgcgccctgggttgggctgatgatgagaaccttatattgtcctgaaaagaggtgatgacttaacaatcatgctcaataggattacattgaagcccaggataggtaagaattagggaagatgatgcagggatcccaagatctccagctagaccacacttattttgcactggagaacttgagaacttgaagggcatctcaggggagcccaaccctgtctctgagctccttcgtgaggcagcccaggctccccttgcgggcttggtgtctgtgctccgcttctccagggacagggcaatttggtgttccttcctgaatgctccttcttccctgtgtccttcagtgagctcttctgcccaggtggggtccctagctttgagcggcataggtcagtgcatcctgttggggtcatgggccatgagtgaggcagcatggggttggtgagagtcagccttcaggccactagggttttctcagggagccaaccgattactcaccgggagggatggttcctccaggagggtcacttcttgggaatctgaccctaggagcacacatttcctgaagctcggcagggagatggtggtccaggcaggaaagggttccttcaacctaacgtagggcagttcccagctgaaactaggtgggcaggtgaggcttgaggactgcccagtccacatgaaaggggccacaggggctttggggtgccctgggagtcatgctggagttcttcccccaagagggatgggtgatagggtccacgtggtcaggctgcggagattcaaggaatgccacccacccatggccctgaatgggaccaaccctgttgagcaatgggccattttcggcatgtttcaatgcagttgggtcaaggctgagcgctggctggtgcctggtggtgctgcaggccggccctggggctcatgggctttatgccaagggggcaactcccatcccactggggtaatcccttccttgaggtccagtggtgggaagggtggcctcctgaggtgggcagacctgctgtcaagggacctgtcctgggaatttgccacctaggctgcttctgagccatggggtcacctccaggatggcggggtcttcagcccaaggaaaggagaggacaccatgtggtttctgattggctgagtgtggcctggctgtatgtgtgggaggtgtgcagggcatggatggggactcatcagagaaagaatgtggccctggaggcccccaggctttgatttctggtgtgtgcttggagtgggcaccagggtggccctaccatgcccaggggcaaggtctttgcctgccaggtctggagtggctcctggcatcaggaccaccctccttggctcaaccaaccttcagcaggttggctgccttggcccgtgccccatggtcccggtacgaccctggggttgttcgggggatctggcccaggcagtggaggtgctcttggggcccacagtagggcacagcccaggcctcttgccccagcccagtaacccacttgccctgtctttccagggttttgtggcagggaaggccaagggtgctctgcgtccatgttgggtcagtgttctgtaaggattccattacaagggtatcccctacccaccttccctacattgatacatgaggccctggttggacacatgtcctcctcctgtccctacagatggtgaccctgaagaaagacttcagttgggcctgaaggccccgggccagtgtccatcatccaggtgctcagctcccagtgcactgaagctcagacccttcctggttccctggtctcttgcactgagctctggtgagcacaactgggtgctgctggatgcatgcatggggaggggggtgccctgggttggggtggtgatgagaaccttgtattcttctgaagagaggtgatgacttaaaaaccatgctcaataggattacacttaggccgaacctaggtgagaatgttggaagaggacgttgggatcctattatccctggcagagccactgtattttgggctggagacctggaggccctgaaagggcatctggagggggcccaaccctgtctctgtgctcctgcatgagggtccccaggctccctgtccagccttggtgttggtgctctggtaccctggggatggaacaagttggtggctctttcctgagcccccattctccctttgtgtctttcagtgagcttttctgcccaggtgggcaccctggcattgattagcctccttggttgtccatgacctggctggtggcccgatcctgtgcccagtggtcccagggcagccctggcatcatacggggcagctgttttgggcagtggaggtgctctccaggcctgaagtatggcacagcctgggcattttacctgagaccagtgacctgcctgccttgtccttcctgggttcggtggcagggagggccaagggtgccctgcgtcagtgatgagtcagtattttgtgtggatctcatcacctgtccatggagggaaagcaagcatgagctggcacccaacacccccttctccgcatggagggtggtcacatgtcctccacctgtgcccccagatggtgagacttgaggaagacttccactgggcctgcttttcctgagccagtgcccatcacccaggtgctcagtccctggtgcactgaagctccagcccttcctggcgccctggtctcctgaactgagctgtggtgagcacatccgggtttcactggatgtttgtgcggggagggggttctctgggttgggtcaatgatgagaaccttatattgtcctgaagagaggtgatgacttaaaaatcatgctcaataggattacgctgaggcccagcctaggggagaattttggcagaggatgccgggatcccaagatttccgggagggccacttgtattttgggttggagacctggaggccctgaagggcgtctggaggtggcccagtgctttctttgcgctcctctgtgaggcagcccaggctccctttgtgggcttggtgtttgcgctcctcttctccagtgatggggcacgttgggggctcctccctgagtcctggttctccccttgtgtctttcagtgagctcttctgccaagcggttcccctggcattgaccaacataggtgagtggatcctgctggcatcatgggctatgagctaggccgcatgggtttgctgagggtcagacttcaggccccaagggtttcctcagggaaccgacctcaattcccaccatgtgactgccaggtttgcaacagtgcatagcttccgagctaccctccttggttggccgggagctggttggaggctgtggcccatgcctagtagtcacagggcaggcagactgccctgttttttcagggtgtggtgacggggagggccaagggtgccctgcatccatgatgggtcagggatttcaggagggatggtttctccaggagggcagcttccttgggaatcttacccaaggaggatgtcttccctgaagccctgcaggggtgacgatggtccagatagcaaaggtttccttcagccccatgcaggacatcacctagttgagatatggtatgtgggtcaggccttgaagactgcccaggccacctgaggggcccagaagggctctggggtgccacaggtgttatgtaggagctctcagtccccagacttgtttcgtggggttggtgacggggttgggttgtggaggttcaaggatttcatcccacctgtgaccctgaatggggccaaccctgttgagcaacaggccatcccaatggcacgtattgagcctggtggggtgtggtgcagtttcaatagggttgagtcaaggctgagatccatctggtgcttggtgctgctgctggccagccctgggacccgtgggctttgggctaagggggtagcccacatcctattgagggtaacccattctccgagtttgagtaacggttaacagtggcattctgaggtgggaaggcccactgtctagggtcctatactgggaatttgccaccccgggttcttctgagacaagtggtcacctccagggtcatggggtcttgggcccaaggaaaggagaagataccatgtggcccttgattggctacatgtggcccaggtctgtttgggaggtgtgtgggatgtggatggggtcccaccaatgaaagcacatggcctgggtccccaggctgtgattttcagtgcacacttggagagggtgcctcggcgggtacctaccacatccatgggcaggctatgtgactaccaggtttgcaacagtgcatagcttccaagctaccctccttggttggtcgggagctggttggaggctgtggcccatgcctagtggtcacagggcaggcagacggccctgttttttcagggtatggtgatggggagggccaagcatccatgatgagtcggtgttccacatggaacccattacgtgggtatctcttaccccttcctcatatggagatgtgaggccctatttggacacatatcctcctcctgtacccccagatggtgagcctggaggaagacttgcgttgggcccaaaggccctagaccagtgtctgtcagccaggttcccaacccccgatgcgctgaagctcaagcctttcctggcaccctggtctcctgcactgagctgtggtgagtatatcctggtcctgctggatgcatgtgcagggaggtgggtgccttgggttgggtcaatgatgagaaccttatattgttctgaagagaggtgattatttaaaaatcatgctcaataggattacgctgaggcccagcctagttgagaattttggaggaggacactgggataccgaagtcccccgcagggactctgtattttgggctggagaccttgaagccctgaagggcatctggaggtggcccaacctgtctctgtgctcctccctgaggcagcccaggctccttttgtgggcttggtgttggggctccagttccccaggtcagggaatattggtagctctttactgagcccctgttctccctttgtgtctttcagtgagctcttctgcccaggcgggccccctggaattgatgggtataggtgagtgcatcctgctggggtcatgggccatgagccaggccacgtggggtcaccaggggtcccccttctggccatgagggttttctcagggaaccgacctgaattaccactggggaggcataggttctccaggagggcggctattttgggaatcggatccaagggggacaccttccctgaagccctgtgggtgtgatggtggtccaggcaggaaagggtcccttccaccccacacagggcagctcatagctgagagttgatgctcaggtcaggcctcaaggatttcccaggccacatgagggggacagaggagctctgggtgccacgggggtcacataggagctctcagtattcggtatgtcatgcacaaatgggcctcttgggttggattgtggagattaaaggatcgcgcaccaccgtggccctgaataggaccatccttattgagcaatgggccatcccagtgagtctcctggagcctggtggaggggagggggtggcattgtttccctggggatgggtcaaggcagagctctggccagcaccttgtggcttctgcaggtcagccttgggactcatgggcattgggccaagggggagcccgcgtcccactgggggtcaccctttttccgacgtcaagtatctggaagagtggcctcctgatgtgggaaggcctgctgtcgagggacgtgtcccaggagtttgtcgctcaagtttcttctgagctttggggtcacatccagggtggcggggtcttgggcccaagcaaagcagagggcaccaagtgtctcctgattggccatgtggctgtctctgtgtgtgggaggtttacagagtatggatggggacccaccagaggaagcacgtggccctgcagcaccaggctgtgatttctgttgcacacttggagaggttgcctggacacgtgcccttcatgcccagtgacagactatgcaactaccaggtctgcagcagggtgtgacatctgggctagcctccttggttggccgccacctggctggtggcccggatctgtgcccaacagtcccagtgcagcactggggtcatgcaggggagctgttttggacagtggaggtgctctcggggcctgcaatatgatgcagcctgggcgttttgctcaagcccagtgacccacctgccctttcctttctgggttcagtggaagggagggccaacagtgtagtgcgtacttaacaagtcagtatttcacattgaactcatcacatgtgtccatggagggcaagcaaaggtgagctggcacccccgacccccttccccaaacggaggtcagtttgggcacacgtctccctcctgtctccccagatggtgaccccggaggaaaatttgtgttgggcccactatccctgggccaatgtcagtcagctaggcacccagcccccagtgcgctgaagctcaggaccttcctagtgccctcggctcctgcactgagctctggtgagtccatctgggtcctgctggatgcatgagctgggggcgggagggtgccctgggttgggtcagtgatgagaaccttatattgtcctgaagaaaggtgatgacttaaaaatcatgctcaataggattacactgaggcccagcctaggtgataattttggaagaggatgctggaattctgaggtccctgacagagcagctgtattttgggctggagaccttgaggccctgaagggcatcttgtgggcccacccctatctctgtgctcctctgtgaggcagcccaggctccctgtgctggcttggtatccgggctctgggtccctggtgacggggcatgttggaggctccttcctgagcccctgttctcccttgtcattcagtgaactcttctgcacaagtgacccccccagccttgagcggcataggtgagtgcatcctgttttggtcatgggccatgagtgatgcagcatggggtccctgacattctgcctttgggccaccagggttttctcaggctgccaacctactccccaccagggagcgatggtttctcaggagggctgcttccttgggaatctgacccaaggagcaagtctctcctgaggccctgcaggggtgacagtggtccaggctggaaagggttccttcagcccaatgtagggcagctcccagctgaaactcagtgggcaggtcaggcctcgagtattgcccaaggcacatgggggagtgaggcacgggggatacagtgcgccgtggaggtcacactggagttctcccctccctggagagggatgagtgactgggtccacacggtcaggctgtggagattcaaggcatgctccacacccatggccttgaatgggaccaaccctgttgagcaataggccatcttagtggcacctccttgagcctggtgggggacggcactgtttcaatgaggttgggtcaagagtgagctctggctggcacctggtggtgctgcaggccctgggacttgtggactttgggccaagggagcagctctgatcctgctggggacaagccttccttgaggtccagtggtgaaaagagtgtcctcctgagatggcaaggcctgctgtcgagggacctgttctaggaatttgctgcccaggctgcttctgagccttggggtcacctcagggggtggcagggtcttgagcccaagaaaggaaaagacacgatgtggttcctgattggctgagtgtgacccggctctgtgtgtcagagttgggcaggacatggattgagacccaccatagaaagcatgtgatcctggaagcccctaggcttggagagggcaccagggccagcgcccaccacgcctaggtacgatctctcggacttccaggtctgcagcggctcttggcgtctgggccagcatgcttggttggccaggggctggttggtggccctgtcttgtgccctgtgtccccggtatggccctggggttgtgtgtggtagcaggcctgggcagtggaggtgctcttggggcctgcagtagggtgctgcccaggcatcttgcccgagccaggtgacacgcttgccctgtctttccagggtttggcggcagggagggccaagggtgcccagtgtccgtgagggatcagtattcagcatggatcccatcacatgagtatcccttagccccttctctacattgatgtgtgaggccctggttagacacatttcctcctcctgtccctccagatggtaagcctggaggaagacttgtgttgggcccacaggccccaggccaatgtctgtcagccaggtgctcagcctctggtgcgctgaaactctgacccttcctggcacactggtctcctgcactgagctggggtaagcacatctgggttgcactggatgtttgtgtggggagggggttccctaggttgggtcaatgatgagaacctgatattgccctgaagagagatgatgacttaaaaatcatgttcaataggattacgctgaggcctagcctaggtgagaattttggaagcagatgctgggatcccaaggtcccttgcagggccatcgtatgttgaactggagacctggaggctctgaagggcatctggaggtcgtgcaacctgtctctgcactcctctgtgaggcagcccaggctccctgtgtggggttggtgttggtgctatggttccctgggggtggggaacattggtggctccctccagagcccctgttctcaccttgtgcctttcagattttccacctaggaggtccacctggcattgactgacataggtgagtggatcctgctggggtcatgggtcatgagccagaccatggggggatcccagagattcagtctttgggcaacagttttctcagggagcagacctgaatttccacctgggagggaagggttctcctggagggcgacttttttgggaatcggacccaaggaggatgccttccctgaagccctgccggggtgatggtggtccaggcaggaaagttccttctgctcaatgcagggcagcacccagctgagactcggtgctccggtaaggcctccagaactgcccaggtcacataaggggggccagaggggctacgaggtgccacggggtaacaggggagctcttggtccccagagtgtggtgcatgaatgggcccattccgttgggtctcagagatttaaggattgcaccacaccatggccctgaatgcaaccgtccctgttgatcaatgggccatcccatgggtctcctggagcctggtgggaggcagtgttgttttcctggggttgggtcaaggcggagctctggctggtacctggtggtgctgcaggtcagccctgggacttgtgggctttgggccaaggggcatcccgcatcccgctgggggccaccctttctccatggtcgagtgtcgtgaagggtggcctcctgagttgggaaggcttgctattgaggcacttgtactgtgaatttgttgctcaggctgcttgggagccatggtgtcacctccagggtggcagggtcttgggaccaagcaaaggagtgggcaccatgtcactgcagataggccatgtgtgactggctctgtgtctgggagatatgtggagtatgaatggggacccaccattcatagagaaagcaagtggccctgcagcccgaggctatgatttccggtgcacacttggagagggtgcctttacacccaagtaccaggctcagaggtaggctatgccactatcaggtctgcagtggcacgtggcatctgggccagcctccttggttggccatgacctggctggtggcctgggcctgtgcccagtgttcccagggtagttctagggtgctgcgggggagctgttttggctagtggaggtgctcttgggtcctgcagtacagcacagcctgggcgttttgcctgagcccagtgacctgcctgccttgcccttcccaggatcggtggtagggaagaccaggggtgcccggcataggtgatgagtcagtatttcacatggatatcatcacatgtgtccatggagggggagcaaacatgagctggcacccgccacccccttctccacatgaagggtggtcacacgttctccatctgttcctccagatggtgagacttctgtcggcctcgcttttcctgggccagtgtccatcagccaggtgctcagccccagtgcactgaagctccagcccttcctggcgccctggactgagctgtggtgagcacatccgggttccactggatgcgtatgtgggaaggggggtgccctgggttgggtcaatgatgagaaccgtatattgtcctgaagagcggtgatgacttaaaaataatgctcaataggattacgctgaggcccaccctaagtgagaaatttggtaggggatgttgggatcccgagatttctggcagggccactgtagtttgggttggaggcctggaggccctgaagggcatctggaggtggctcaactctttctctgtgctcctccgtgtagcagcccaggctccctgtgcgggcttggtgttgttgcttctgttccttgggggcagggcatgtgggtggctcctccctgagccccagttctccccttgtgtctttcagtgagctcttctgccaagggggtcctcctggcattgaccaacataggtgagtggatcctgctgctgtcatggtccgtgagccaggctgcttggggttgccaagggtcagacttcgggccatgaaggtttcctcagggagctgaccctaattcccatgagggaggcatggtttctccaggaggtcagcttccttgggaatctgtgacttgacagggttgagtcgcagaggttcaaggatctcatcccacctgtaaccctgaatggggcccaccctgttgagcaactggccatcccagtggcacatattgagcctggtggggggtggtgcagtttcaatggggttgggtcaaggctgagatatggctggtgcctggtggtgctgcagtccagccctgggatccgtgggctttgggctgagggggaagcctgcatcctattgggggtaacctgttctccaaatttgagtgattggtgggaaggcctactgtctgaggtcctgtactgggaatttgccacctcagcttcttctgagccatagggtcacctccagggtcatggggtcttgggaccaaggaaaagagaagataccatgtggcccttgattggccgagtgtagcccagctctgtgtttgggaggtgtgtgggatgtggatagggtcccacctgtgaaagcatgtggcccgggtccccaggctgtgattttcagtgcacacttggagagggcaccttggtgggtgcccaccatgtccaggggcaggctatgtgactgccaggtttgcaatggtgtgtagcttccttctaccctccttggttggctgggagtgggttggttgctgtggcccatgcccagtggtcacagggcaggcagactgccttgttttttcagggtatgctgacagggagggccatgggtgccctgcattcatgatgagtcagtgttccacatggaacccattatgtgggtatctcttattccttctacatatggagatgtgaggccctatttggacacatgtcctcctcctgtacccccaggtggtgagcctggaggaagacttgcattgggcccaatggccctggaccagtgtctgtcagccaggttcccagcccccgatgcgctgaagctcaagcctttcctggcaccctggtctcctgcactgagctgtggtgagcatatcctggtcctgctggatgcatgcgtggggaggggttgtcctaggttgggtcaatgatgagaaccttataatgttctgaagagaggtgatgacttaaaaatcatgctcaataggattacgctgaggcccagcctaggtgataattttggaagaggacactgggtcccgaagccccctgcagggcccctgtgttttgggctggagaccttgaggccctgaaaggcatctggtggacccaactctatctctgccctcctcaatgaggcagcccagcctccctgtactggcttggtatccgggctccgggtctctggggacggggcacattggaggctccttcctgagcccccattctctcctgtgtctttcagtgagctcttcggcccaagtggtccccccggccttaagcggcataggtgagtgcatcctgttttgatcatgggccatgagtgttgcagcatggggtccccgacattcagccttcaggccactaggcttttctcaggctgcaaacctactctccaccagggagcgatggtttctcaggagggccacttccttcggaatctgacccatggagcacgcctttcctgaagccctgcagaggtgacagtggtccaggcaggaaggggttccttcagccccaatgtagggcagctcccagctgaaacttggtggacagatcaggcctggagtactgcccagggcatatggggaggagggacacagggaatgtggcgcaccctagaggtcacactggagttctgtctccctggagaggggtgagtgattgggcccacatggtcaggctgtggagattcaaggaatgctccacaccgatggccttgaatgggaccaaccctattgagcaatgggccatcttagtggcacctccttgaacctggtgggggatggcactctttcaatgaggttgggtcaaggctgagctctggctggcacccagtggtgctgcaggctggccctgggacttgtgggctttgggccaagggggaagcttccatcctgctgggaacaacccttccttgaggtccagtggcaggaaggggggcttcctgaggtggaaagccctactgttgagggacctgtcctgggaatttgctgtccaagctgcttctgagccatggggtcacctctagggtggtggggtcttgagcccaaggaaaggagaggacaccatgtggttcctgattggctgagtgtggcccggctctgtgtgtcggagttgtgcagggtatggattgggacccaccagtgaaagcacatggccctggaggtccgcaggcttggagagggcaccagatctggcacccaccatgcccaggtacaggctctgggactgccaggttgcagcagctcttggcatctgggccaccctccttggttggccaggagctagttggtggccctgtcccatgccccatgtccctggtatggccatggggtcatgcagaggaaccggccctggcatggaggtgctcttgcaacatgcagtagggtgcatcccaggcatcttgcctgagccaggtgacccgcttgccctgtctctccagggtttggtggcagggagggccaagggtgccccgtgtccatgttgggtcagtgttcagcatggatcccattgcatgagtatcacttagctccttcccagcattgatatgtgaggccctggttggacacttgtcctcctgtccctccagatggtgagcctggaggaagactcgtgttgggcccacaggccccaggccagtgtacgtcagccaggtgctcagcccatggtgtgctgaagctctgacccttcctgactccgtggtctcctgcactgagctgtgatgaccatatccaggtcctgctagatgcatgcgtggggaggcagggtgccctgggttgggtcaatgatgagaaccttgtattatcttgaagagaggtgatgacttaaaaatcatgctcaataggattacactgaggcccagactaggtgagaattttggaagaggatgctgggatcctgaggtccccaacagggccaccatattttgggctggagacctggaggtcctgaagggcatctgtagggggcccaaccctgtctctgcactcctccctgaggcagcccatgctccctattcgggatcggtattggtgctccacttccctgggggcaggacacgtgggtggctactccctgagcccccgttctccccttgtgtctttcagtgagctcttccaaacaggtgggctccctagcattgaccgacagaggtgagtggatccttctgggattatgggccatgagccaggccatgtggggtccccaaggttcagcctttggatcccgagagttgtctcagacagccaacctgatttgccacctgggagagatggcttctccaggagggtgggtttttgggaattggacccaaggaggacgccttccctgaagccctactgggatgatggtggtccaggcaggaaagggttccttcacccagctgagactcggtgttccagtaaggcctcaaggacctccctgccacatgaaggggcccagaggggctacgaggcaccacaggagtgacaggggagctcttggtccccagagtgtggtacatgaatgggcccatggggttgagtcgcagagattcaaggatgctgcaccacccatggccctgaatgtgactctcctcctggagcctggtggggggtggcgttttttccctggggttcggtcaaggtggaactctggtcagtacctggtggtaatgtaggtcagccctgggactcgtgggctttgggccaacggacagcccacatccctctgggggtcaccctttctctgaggtcgagtgtcgtgaagggtggcctcctgaggtgggaaagcccaatgtcgaaggacctgtactgagaatttgttgcttaggctgcttaggatccatgttgtcacctccagggtggtgggatcttgggaccaagcaaaggagagggcaccatgtggctgccagtggctatgtgtgactggctctgtgtctgagaggtgtgtggatggggacccaccagagaaagcaagtggccctgcagccccaagatgtgatttctggtgcaggcttggagagggtgcctatacctgctcccaccacgcccaggggcaggctttgccactgcaggtctgcagtgccacgtggcatctgggccagccaccttggttggccgtgacctggctggtagcccgtgcctgtgcccagtgttcccagggctgccctggggtcttgctggggagctgttttgggcagtggaaatgctcttggggcctgcagtatggcacagcctgggggcattttgcctgagcccagtgacctgcctgccttgtccttcctgggttcggtggcagggagggccaagggtgccctacattggtgacaagtcaatattttgcatggatctcatcacgtgtccatggaggtgggggcaagcgtgagctggcacgcaccccattctccccatggagggtggtcacatgtactccacctgtgtccctagatggtgagactggaggaagacttccattgggcccacttttcatgggacagtgtccatcagccaggtgctcagcccccagtgcattgaagacccagcccatcctggcaccctagtctcctgcactgagctgtgctgagcacatctggcttccactggaagttttttttgcgaggaggggcttccctgggttgggtcaatgatgagaaccttatattgtcctgaagagaggtgatgacttaaaaatcatgctcaataggattacgctgaggcccaacctaggggagaattttggaagaggattatgggatcccaaggtccccaacaaggccactgcattttgggctagagacctggaggctcttaagagcatctggaggtggcccaacctgtctctgctccttcgtgatgcagcccaggctccctgtgtgggattggtgttggtgctccatttccctggcatggggaatgttggtggctccttcctgagctcctgttctcgccttgtgtctttcagtgagctctgccacccaggacatccccctggcattgactggcataggtgagtggatcctgctggggtcattggtcatgagccagaccatgtggagtccccaaggttcagcctttgggccacaaaggttttctcagggagcagacctgaatttcacccgggagggaagggttgtcctggagggtggcttttttgggaacctaacccaaggaggacccattccctgaagccctgcaggggtgatggtggtccaggcaggaaagggttccttctgctcaatgcagggcaacacccagctaagatgcggtgatctggtaaggcctccagaactgcccaggccatatgaggggggccagaggggctacagggtgccacaggggtaacaggggagctcttggtccttggagtgtggtgcctgaatggacccatgggattgggttgtgtagattcaaggatcacaccctacccacagccctgaatgtgactcttcctcttgagcaatgggccatctcagtgggtctcctggagcctggtcggggggtggtgttgtttccctggggttgggtctaggtggagctctggctggtacctggtggtgctgcagatcatccctgggacttttgggctttgggccaagggacagcccgcatcccgcttggggtcagcctatctccatggtcaagtgtcatgaagggtggccccctgaggtgagaaggcctactgtcaagggatctgtcccaggattttgttgctcaggctgcttctgagccatggcgtcacatccacagtggcagggtcttgggcctgagcatagcagagggcaccatgtcgttctggattggccaagtatggcctagctctgtgtgcgggaggtgtgcagagcatggacggtgacccaccagagaaagcacgtggccctgcatcccaggctgtgatttccaatgcacacttggagagggtgtcttgatttgtgcccaccatgcccaggggcagactacgtgatagccaggtctgcagcctgagccacgtgtggcatctgggccagccaccttggttggccgtgagctggctggtggccttggcctgtggccagtggtgccagggcggccctggggtcgtgtgggggagccatgttgggcagtggaggtgctgtcagggcctgcagtacagtgcagcctgggcatttggcctgagcccagtcacccgcctgctctgttcctccagggtttggtggcggggagggccaagggtgccccgcatccgtgacgactcagtaattcacatggatcacatcacatttttccttggagggcaagcaaatgtgagcccccaccccccactgccttccccacatggaggtcattttggacacatatcctcctctagtccccctagatggtgagactggaggaagacttgcattatgcccgctgttcctgggccagtgtcagtcagccaggttcccagctccaagtgtgctgaagctcaggcccttcctggcaccctcagctcctgcactgagctggggttacatccgggttccactgtttgcatgcaaagggaggggtgtaccctgggttgggctgatgatgagaaccttatattgtcctgaaaaaaggtgatgacttaaacatcatgcttaatagtattatgctgaagcccaagctaggtgagaattttggaagatgaggctgggatcctgagatccccggcagggccacacttattttgggctggaaaatttcaagacctgaagcgcatcttgtgggggggcaatcctgtctctgtgcttctccgtgaggcagcccaggctcccgttgcgggcttggtgcccatgcttcgcttccccaggggtggggcaatttggcatcctcttcctgagccctccttcttccctgtgtctttcagtaagttcttcttcccaggtggggcccctggctttgagcggcatgggtcagagcatcctgtcagggtcatgggccatgagtgaggcagcgtcggttcgtcgagagtcagcctttgggccactggggttttctcagggagccaacaggttacccatcaggagggatggttcctccaggagggtcgcttccttgggaatctgactctaggagcatgcatttcctgaagctctgcagggtgatggtggtccaggcgggaaagggttccttcagcccaacataatgcagttcccagctgaaactcggtggcagatcaggctcaaggactgctcgggccacatgatgggggccacaggggatttggggtgccctgggggtcatgctggagttcttgccccaagaggggtgggtgatagggcccatgcgatcaggctgcggagattcaaggaatgctacccacccatggccctgaatgggactgaccctgttgaacaatgggccattttaatggtgcctccttgagcctggtaggtagtggcattgtttcaatgcggttgggtcaaggctgaactctggctggtgcccggtggtgcccacatgggctttgggccaagggggcagctcatatccctctggggtcaccccttccttgagattcagtggcaggaagggtgttctcctgaggtggaagacctgctgtcaagggacttgtcctgggaatttgccacctaggctgcttctgagccatggagtcacctccagggtggcagggtcttgagcccagggaaaggagacaccatatggtttctgactgggagtgtggcctggatctgtgtgtgggaggtgtgcagggcatggatggggacccatcagagaaagcatgtggccctgtaggcccccaggctttgatttctggtgtgtgcttgcagtgggcaccagggcagccctaccatgcccaggggcaggctctgtgactgccaggtctggagtggctcctggcatgaagaccacgctccttggttggccatgagcaggttggttgccctagcctgtgccctgtggtcctggtgcagccctggggttgtttggggagacagcaccggcagtggaggtgctctcaaggcctgcagtagggcgcagcccaggtgtcttgcccgagcccagtaacccacttgccctgtctttccagggtttggtggcagggagggccaactgtgccccgcatctgaaatggatcagtgttctgcatggatcccatcacaagggtatcccctacccaacttctgtgcattgttatgtgaggccctggttggacacatgtcctcctcctgtccctgcagatgctgaccctggaggaagacttgtgtcgggcccccaggccccaggccagtgtccatcagccaggtgctcagctcccagtgcgctgaagctcagacccttcctggcaccctggtgtccagcactgagctgtggtgagcccatccgggtcctgctggatgcatgaatggggaggggcctgcccagagttgggtcaatgatgagaaccttacattgtcctgaagagagatgatgacttaaaaatcatgctcaataggattacgctgaggcccagcctaggtgagaattttggaagaggacggctgggatcctgagatcccagtcagggtcactgtattttgggctggagacctggaggccctaaagggcatctggaagggggcccagccctgtctctgtgctcctccgtgaggcaacccacactccctgtgtgggcttggtgttggtgctctggttccccagggacagggcgggttggtggctccttcctgagcccctattctccctttgtgtctttcagtgagcttttccacccaggtgggccccctggcattgaccgacataggtgagtgcatcctactgggataatgggccactagatagtctgtgtggggttgctgaggtttagcctttgggccacaagggttttctcaggcagccaacctgaattcccacctgggagagatgggttctccaggaggcagcttttttgggaatcagacccaaggaggacaccttccctgaagccctgcaggggtgatggtggtccaggcaggaaagggttccttctgcccaactcgaggcccaatgcagggcagtgcccccctgagaattggtgctctggtaagggctcgaggactgcccaggccacatgaaggaggtcagaggggctatggggaaccatgggggcaacaggggagctcttggcccccggagtgtggtacatgaatgggcccatggggttgggtcacggagattcaaggattgcatctcacccacggccctgaatgcgaccatccctgttgagcaatgggccatcccagtgggtctcctggggcctggtgtggggtggcattgttttcctggggttgggtcaaggcggagctctgactggtacctgatggtgctgcaggtcagccctgggactcgtgggctttgggccaagaggcagcccgcatcctgctgggggtcgccttttctccgaggttgagtgtcgtgaaggatggcctcctgaggtgggaaggcccactgtcaaggcacctagactaggaattgttcctcaggctgcttgggagccatggtgtcacctccagggtggcgggatcttgggactaagcaaaggaggggacactacgtggctcccaattggccatgtgtggctggctctgtgcctgggaagtgtgtggagtatggatggggacccaccagagaaagcaagtggccctgcagtcccagaatgtaatttctggtgtaggcttggagagggtgcctatatgcatgcccaccatgcccaggagcaggctatgccacttcagggtctgcaggggcacctggcatatgggccagcctccttcgttggctgtgacctgggtggtggcctgtgcttgtgcccagtggtcccagggtagccctggggtcgtgcaggggagccgttttgggcagtggatgtgctctcgggtcctacagtacagcacagcctgggtgttttgctcaagcccagtgacctgcctgccttgtccttcccgggttcagtggcagggagagccaagggtgccccacattggtgacgagtcagtattttgcatggatctcatcacacgtgaccatgaaggacgagcaagcatgagctggcaccagccacccccttctccgcgtggagggtggtcacatgtcctccacctgtgcccccagatgatgagactggaggaagacttccattgggcccacttttcctgggccagtgtccatcagccaggtgctcagcccctggtgtactgaagctccagcctttcctggtgccccagtcttctgcactaagctgtggtgagcacatccgggttccactggatttttgtgcggggagggggttttctacgttgggtcaatgatgagaatcttatattgtcctgaagagaggtgatgacttaaaaatcatgctcaataggattacgctgaggcccagcctaggtgagaattttggaaggggattatgggatgctgaggtcctcagcaaggccactgtattttgggctagagacctggaggctctgaagggcatctggaggtggcccaacctgtctctgcgctcctccatgaggcagcccaggctccctgtgcagggttggtgttggtgctccggttctctggtgtggggaatgttggtggctccttcctgagccctcattctcaccttgtgtctttcagtgagctcttccacccaggagggccccttggcattgactggcataggtgagtggatcctgctggggtcattggtcatgagctagaccgtgtggggtccccgaggttcagccttcagtccacaagggttttctcggggagcagacctgaatttccacctgggagggaagggttctcctggagggtagtttttttgggaatctagcccaaggaggatgccttccctgaagccctgcaagggtgatggtggtccaggcaggagagggttccttctgcccaatgcaggacagctcccagttgagactgagtgctccagtaaggtctccaggactgcccaggccacatgaaggaggccagaggggctatggagcaccactggggtaataggggagctcttggtccctggagtgtggtgtgtgaatggggtttggtcacggagattcaaggatcacaccccacccatggccctgaaagtgaccatccctattgagcaatgggccatcccaccgggtctcctggagtctggtgcagggcgacgttttttccctggggttgggtcaaggtggagctctggtacctggtcatgctgcaggtcagccttgggactcgtaagctttgggccaagggacagctggcatcctgctggggggtcaccctatctctggggtcgaatgtcacgaagggtggcctcctgaggtgggaaggcccattgtcgagggacctgtcccaggattttgttgctcaggcttcttctgagccatggtatcacctccagggtgacagggtcttgggcccaagcaaaggagagggcaccatgtcgctctgagttggccaagtgtagcctagctctgtggtgggaggtgtgcagagcatggctggtgacccaccagagaaagcacgtggccctgcagccccaagctgtgatttccagtacatgcttagagagggcatcttgatgtgagcccaccacacccaggggcagactacgtgactgccaggactgcagtggcacatggcatctgggccagccttcttggttggccatgacctagctaatggccctggcccgtgccttggggtcatgcaggggagccctcttggacagtggaggtcctctcagggcctgcaatatggcgcaggctgggcatttggcccgagcccagtgacctacctgccctgtccttccagggttgggtggcagggagggacaagggtgccccatgtcagtgacaagtcagtatttcacatggatctcatcacatgtgcccatggaggacgagcaagcgggaactggcacccgctacttccttccctacatagaggccattttggacacatgttctccacctctctcccagatggtgagacgggaggaagacttgtgttgggcctgctgttcctgggccagtggccatcagcctgttgcccagcccctgaggcgctgaagctcaggcccttcctcacaccctggtctcctgcactagctgtggtgagcacatccgggtcccgctggatgcatgcaagaggtggttggtctcgtgggttgggtcgatgatgagaaccttatattttcctgaagagaggtgatgacttaaaaatcatgctcaataggattacgctgaggcccagcctaggtgagaactttggaagaggatgctgggatcctgagatcccaggcagggccactatattttggggtggagaactcaaggccctgaagggcctctcagggggtgccaccctgtctctgtgcccctctgtaaggcagcccaggctccctgtgtgggcttggtgtctggtctctggttccccgggggcggggcatgttggtggctccttcctgagcccgctttctcccccatgtctttcagtgagctcttctgcccaggtggggcccatggccttacacgacataggtgagtgtatcctgttggggtcatgggccatgaatgaggcagcatggggccatttagggtcagccttcgggccactagagttttctcagggtgcgaccggggagggaacatttctccagtagggtcacttccttggaaatctgatcctaggagcacgcatttcttgaagtcctgcaaaggtgatggtggtccagacaggagagggttccttcagcccaacatagcgcagctcccagctgaaactcggaaggctggtcaggcctcgaggactgcccaggccacatgaggtgggcaacaggggctctggggcaacctgggggtcacgctggagttctccctctctggacagtggtgggtgattgggcccacgcagacaggccccggagattcaggactgcaccccatccatggccctgaatgggaccgaccctgttgagtaatgggccatctcagtggtacctccttgagcctggtagggggagacactgtttcaatgcagttgaatcaaggctgagctctggctggtgcctggtggtgctgcaggcagccctgagggttgtggtctttgggacaaggggtagctcacatcccactggggtcaccccttccttgagattcagtggccaaaagggtgtcctcctgagatgggaagtcctgctgtcgagggacctgttctgggaatttgccacacaggctgcttctgagccacggggtcacctccagggtggtagggtcttgatcccaaggaaaggagaggacaccatgtggtttcttattgaccaagtgtggcctggctttgtgtgtgggaggtgtaacgcaagatgaggacccaccagagaaagcacgtggctctggaggcccccagggtttgatttccggtgtgtgcttggagagggcaccaggttgggcacccaccacgcccagggcaggctctgcgactgccaggtctgcattggctcctggtgtcagggccagactcattggttggccatgagcaggttggttgccctgacccatccccatggtcccagtgtggccctggggtttttcaggggagccggctcaagcagtggaggtgcgcttagggcctgcagtagggaacagcccaggcatcttgcctgagcccagtaacctgcttgccttgtctttccagggtttggtggccgggagggccaatgatgctctgcgtctgtgttggatcagtgttcttcatggattccatcacgtgggtatcccctacccaccttccccttgctcatacgtgaggccctggttggacacatgtccttctcctgtcaccccagatggtgagccttgaggaagacttgtattgggcccccacaggccccaggccagtgtccgtcagcctggtgctcacccccagtgtgctgaagctcagaccctccgtggcaccctggtctcctgcactgagctgtggtgagcacattcaggttccgctggatgcatgcatggagaggggcttgcccttggttgggtcagtgatgagaaccttctattgtcctgaagagaggtgatgacttaaaaatcatgctcaataggattacgctgaggcccaacctaggtgagtatgttggaagaagacactgggatcccgagatctccaacagggcactgtattttgggttggagacctggaggccctgaagggcatctggaaggaggcccaaccctgtctctgtgctcttccttggggcagcccaggctacctctgcgggcttggtgttggtgctccagttccctggggccagggaacattgctggctccttcctgagcccccattcctcccttgtgtctttcagtgaacttttcctcccagatgggccccctggcattgactggcataggtgagtgcatcctgctggggtcatgggccatcagccaggccatgtggggtcgctgaggttcagcctttgggccacaagggttttctcaggcagccgacctgaattcccacctgggagagacgggttctccaggagggcagcttttttgggaattagacccaaggaggatacctgaagccctgcaggggtgacggtggtccaggcaggaaagggttccatcagcccgggcaaggcagctcctagctgacactcggtgttcgggtcagtccttgaggactgcctgaacacgagggggtccagaggggctctgggtgccacgggggtcacatgggagctctcagtccctagagtgtggtgtgtgaatggacccttagggttaggtcttggagataaaaggattgtgctccacccatggcctggaatgtgaccgtccctgttgagtaatgggccattccagtgggtctcctggagcctgatgggaggtggcgttgtcttcctggggttgagtcaaggcagagctctggcccatacctggttgtgctgcaggtcagccctgggactcgtgggctttgggccgaggggcagcccgcatcccgctggagattaccctatctctgagatcaagcgtcatagagggtgacctcctgagaagggaaggcccactgtcgagggacctttcctaggattttgttgctcaggctgcttggaatccattgtgtcacctccagggtgatggaggtttgggcccaagcaatggagagggcaccatgtgtctcctgattgttcaagtgtgtcggagatatgcggggtatggatggtggcccaccaaagaaagcatgtgactcaagctgtgatttccagtgcatgcttagagagggcgcctgtatgcgtgccccacatgcccggggtaggctatgcaactgccaggtctgcagtggcgcatggcatcttggccagccttcttggttggccatgacctggctaatgaccctggcctgtgcccagtgatcccagggaagccctggtgtcatgcagcggaggcctcttgggcagtggaggtgctcttaaagcctgcagcatggcacggcctgggcatttatcccaagcccaatgaactacctgccctgtccttccagggttcggtggcaggcagggccaagggtgccccgtgttggtgacaagtcagtatttcacatggctctcatcacatgtgtccgtggaagataagcaagtgtgaactggcacgtcctacctccttccctacatggaggtaactttggacacatgttctccacctctctcccagatggtgagaccggaggaagacttgcattgggcctgttgttcctgggccagtggccatcagcctgttgcccagcccctgatgcgctgaagctcgggcccttcctcgcgccctggtctcctgcactgagctgtggtgagcacatccgggtcctgctggatgcatgcacgaggtgattgatcccctcagttgggtcgatgatgagaaccttatattgttctgaagagaggtgatgacttaaaaatcatgctcaataggattacgctgaggcccagcctaggtgagaattttggaagaggatgctgggatcccgagatccctggcagggccactatattttgggctggagaacttgaggccctgaagggcatctcaggggggtccaaccctatctctgtgcccctccatgaggcagcccaggctccctgtgtgggcatggtgtccgggctctggttccctgggggtggggcatgttggtggctccttcctgagcctgctttctcccccatgtctttcagtgagctcttctgcccaggtgaggcccatggccttaagcggcataggtgagtgtatcctgttggggtcatgggccatgaatgaggcagcatggggccatttatggtcagccttcgggccactagggttttctcagggtgcgaccggggagggaatgtttctccagtagggtcacttccttgggaatctgaccctaggagcatgcatttcgtgaagccctgcaaaggtgatggtggtcccggcaggaaagggttccttcagcccaacatagagcagctcccagctgaaactcagcgggctggtcaggcctcgaggactgcccaggccacatgaggtgggcaacaggggctctggggcaacctgggggtcacgctggagttctccctctctggacagtggtgggtgattgggcccacgcagacaggccccggagattcaggactgcaccccatccatggccctgaatgggaccgaccctgttgagtaatgggccatctcagtggtacctccttgagcctggtagggggaggcactgtttcaatgcagttgaatcaaggctgagctctggctggtgcctggtggtgctgcaggcagccctgggggttgtggtctttgggacaaggggccagctcacgtccctctggggtctccccttccttgagattcagtggccgaaaggatgtcctcctgaggtgggaagtcctgctgtcgagggacctgttctgggaatttgccacacaggctgcttctgagccacggggtcacctccagggtggtagggtcttgatcccaaggaaaggagaggacaccatgtggtttcttattgaccaagtgggacctggctctgtgtgtgggaggtgtagggcaagatgaggacccaccagagaaagtacgtggccctggaggcccccaggctttgatttctggtgtgtgcttggagagggcaccagggtgggcacccaccatgcccagggtaggctctgcaatggccaggtctgcattggctcctggtgttagggccagactcgctggttggccatgagcaggttggttgccctcacccgtccccatagtcccagtgcggccctggggttgttcgggggagccggcccgagcagtggaggtgctgttggggcctgcagtagggcatcttgccccagcccagtgacccaccttccctgtctttccaaggtttggtggccagcagggccaatggtgccctgtgtctgtgatgagtcagtgttcttcatggattccatcacatgggtatcccctacccacattcccctcgctcatatgtgaggccctggttggacacatgtccttctcctgtcaccaccccagatggtgagcctggaggaagacttgtattgggaccctacaggccccaggccagtgtctgtcagcctggtgctcatcccccagtgcgctgaagctcagaccctccctggcaccctggtctcctgcactgagctgtggtgagcacatccaggttctgctggatgcatgcatggggagggccttgattgggtcaatgatgagaaccttatattgtcctgaagagaggtgatgacttaaaaatcatgctcaataggattacgctgaggcccaggctaggtgagaattttggaagggagcgctgggatgccaagatccccggcagggccactagccactgtattttatactgaagaacttgaggccccaaagggcatctcaggggtcctagccctgtctctgtgcccctccgtgaggcagcccaggctccctgtgttgacttggtgtccaggctctgcttcctggggatagggcatgttggcagctccttcctgagcccacgttctcccctgtgtcttctattgagctcttctgcccaggtggggcccatgcccttaagcagtataggtgagtgtatcctgttgcggtcatgggccataaatgaggcagtgtggggtcatcgagggtcagccttcaggccactagcgttttctccaggtgcccccggggagggaacattgctccagtagggtcacttccttgggaatctgaccctaggagcacgcatttcctgaagccctgcaaaggtgatggtggtccaggcaggaaagcgttccttcagcccaacatacagcagctcccagctgaaatttggtgggctcgtcaggccttgaggactgcccaggcttcatgatgggggacacagaagctctggggctccctggggctcacactggagttctccctccctgaagagtggtgggtgattgggcccacagtcaggtggcggagattcaaggaatgcccccacccctggccctgaatgggaccaactctgttgagtaatgggccatcttaatggcgcctccttgagcctgttgggggtgggttgctgtttcaataaggttgagtcaaagctgagctctgactgggcgcctggtggtactgcaggccggcccttccttgggccaagggggcagcttgtgtcccgctggtgtcatcccttccttgaggtccagtggtggaaagggtagcctcctatggtgggaaggcctgctgctcagggacctgtcctggaaatttgccatccaggctgcttctgagccatggggtcacctccagggtagtggggtcttgagtccaagaaaaggagaggacaccatgtggttcctgattggccaaggctccttggttggccaggagcaggttggttgccctggcccatgccccatggtcctggtgtggccctggggttgttcaggggagctggcccaggccgtgaaggtgctctcagggcctgcagtagagtgcagcccaggcatcttgccccagcccagtgacccacttaccctgtctttctaaggtttggtggccaggagggccaatggtgccttgtgcccatgttgggtcagtgttctgcatggatccccatcatatgggtattccctacccaccctccctgcactgatatgtgaggccctggttggacacatgtcctcctcctgtcccttcagatggtgagtctggaggaagacttgtgttggacccccacaggccccaggccagtgtccatcagcctggtgctaatcccccagtgctctggagtttggaccctccctggcaccctggtctcctgcactgagctgtggtgagcacatggatgcatgcttggggtgggggttgcccttggttgggtcaatgatgagaaccttatattgtcctgaagagcggtgatgacttaaaaatcatgctcaataggattacgctgaggcccagcctaggtgagaattttggaagaggacactgggctccccggaatggccactgtattttgcgctggacacctgcaggccctgagggccatctggaaggtccaaccctgtctctctgctcctccaggaggcagcccaggctccctgagggggcttggtgtcgggctcctgttccccggggttggggccggttggtggctccttcctgagcccccattctccccttgtgtctttcagtgagctcttccacccgggcgggcccccggcattgactggcataggtgagtggatcctgcttgtgtcatgggccatgaaccggtccatgtggggtcaccaagggtcagcctttgggataagagggtttcctcagggaaccaacctgaattcccatcagagaggtatgggttctccaggagggccgcttttttgggaattggacccaaggaggataacttccctgatctctgcaggagtgacggtggtccaggcaggaaagagttccttcagccccacccagcgcagcgttctgttgagactcagtgctcaggtcaggcctggaggatttctcaggccatctgagggggttagaggggagctctttgtccatggagtgtggtgcttgaatctgcccttggggttgggtcatggagattcaaggatggtgcctcacccatggccctgattggaattgtccattgagaaatacgccattccagtgggcctcctggagcctgatggggggtggtgtttttttccctggggttgagtcgttgatggggactcaccatagaaagcatgtggctctggaggcccccaggctttgatttccagtgcctgcttggagtgggcaccagggccggcacccaccatgcccaagggcaggctctgcgactgccaggtctgcattggctcctggcatcaggaccagcctccttggttggccatcagctgcttggttgccctggcccatgccccgtggtcctggtgtggccctggggtggttgagtggagctggcccaggcagtggaggtgctcttggggcctgcagtagggtgcagcccaggcatcttgcctgatcccagtgacctgcttgccctgtctttccaggattttgtggcagggagggccaagggtgccctgcatccgtgatgggtcagtgttccacgtggatcccattacgtgggtccatagaggatgagcatgcgtgagccagcgcccccttcccacttcttctcatggagctgtgaggccctgtgtggacagctgtcttcctcttgtcccaccaggtggtgagcccggaggaggacttgcgttcggcccgctggtcccagtgtgtccggaattggtgggttcttggtctcactgacttcaagaatgaagctgcggaccctcgctgtgagtgttacagctcttaaggtggcatgtctggagtttgttccttctgatgttcggatgtgttcggagtttcttccttctggtgggtttgtggtctcgctggcttcaggagtgaagctgcagaccttcgcggtgagtgttacagctcataaaagcagtgtggacccaaagagtgagcagtagcaagatttattgcaaagagtgaaagaacaaagcttccacagtttggaaggggacccaagtgggttgccactgctggctggggcagcctgcttttattctcttatctggccccacacacatcctgctgattggtagagctgagtgatctgttttgacagggcgctgattggtgcgtttacaatccctgagctagacacaaaggttctccatgtccccactagattagctagatacagagtgttgacacaaaggttctccaagtccccaccggagtagctagatacagagtgtctattggtgcattcacaaaccctgagcttgacacagagtgctgattggtgtgtttgcaaaccttgagccagatacagagcgcggattggtgtatttacagtccctgagctagacataaaggttctccaaggccccaccagagaagctagatacagagtgtcgattggtgcattcacaaaccctgagctagacacagggtgctgattggtgtgtttacaaaccttgagctagatacagagtgccgattggtgtatttacaatccctgagctagacataaaggttctccaaggccccaccagactcaggagcccagctgtcttcacccagtggatcccgcactggggctgcaggtggagctgcctgccagtcctgcgccatgcgcccgcactcctcagcccttgtgtggttgatgggactgggcaccgtggagcagggggcggcactcgtcggggaggctctggctgcacaggagcccatggagggggtgggaggctcaggcatggcaggctgcaggtcccgagccctgccccgagggaaggcagctaaggcccggtgagaaatcaagtgcagcgccggtgggctggcactgctgggggacccagtataccctctgcagctgctggcccgggtgctaagcccctcattgcctggggccggcagggccggcccgctgctccgagtgtggggcccgccaagcccacacccacccggaactccagctggcccacaagcgccccgcgcagccccggttcccacttgcgcctctccctccacacctccctgcaagctgagggagcaggctccggccttggccagcccagaaaggggctcccacagtgcagcagtgggctgaagggctcctcaagtgccaccaaagtgggagcccaggcagaggaggcgccaagagcaagtgagggctgtgaggactgccagcacgctgtcacctttcatcaggacagtgtctgtcagccaggtgcacagcccttggtgtgctggagcttgggcttttcttggcagcctggtgtcctgcattgagcggtggtgagcttgtccaggtcccgctggttacctgcacggtgacgggggtgccctcggttaggttgatgatgagaaccttattttgtctcgaggagaggttatgtgatgggtgttgtggcagctctttgtatttcattttcttcagtgctttttgtgtgttctctttgtattttttaccgctttgtgtattttactttcacaaaggcagcagcaaatgttttattggtggtggtatttttcatttttatttacttcctaatttgatagtgttttagttggaatacacagtctcattgtagttgttcagaaatatgctttttttctgtacattatatgattgtgcataatttttgccagttttttttttaattggggactacagttgaatgcactgcctatctcctactttactgaaacagattgtatggaaatctaaagacgagaaagtagacaagcacagcagaggacatttattttgatataaccacagaaattcattgatatgaccttatcatattgatggtttttcaaagaaatataaaatctttcgataatggattgtctcagttgcgtttctccttatatcatgttttgccttcaatacaaattgcaatgcttagaaatttaaagaacaccttctgaagtggaagatctagctaaagaattagattggtattggctgaaatgttgcagtaatcacatgatagggttaatacaacatgagttacatgctgagtgctctaaggtagaaagtaggtaacaaggaataacaggtaggtaatgtaagtcgggagaaggaaactctaggacagaatcattagaaaaggcttgacgtcaacagcagtgtatagaatttacagtgtatagaatttacagtgcatagaatttacaataagtgcctttttttgtgctcatcaatgctcttgcttatattgtaggaggagttagttcccttgaagaaatatcaatacaaatttccaaattgcaatgcagagggaaaaaagaatgagaaagtaaaaaatatccaagaactctggaagcatttcaaaaagtgtaaaaatgcatagtgacaatgtcaggagaataaggagataaaggaaaagaaatatttgacacaacaatgacttgagcactttctaaaattaatgatggacagaaacccacatgttcaggaagctcagagagcactctgcagaataaaaatattttacaaatcgacacctttgcatttcatatttaaagtccagaaaatcatagactaagggaaaagcttgataggagcaataggaagaaaaccatcttacctatggagcaacaagaataaaaattgctttgaaattatcttcagaatccatgaaagcaagaagtgagtcagggtgaaatatttagtgttaaaagtaagaaacaaaaaaaagtaccaactttgaattttctgctcatcaaaattattcttcaaaagtgaaggagaaatactctctgagaccaacaaaaattgctagaacttcttgccactacaccaaccttttaataaacgtaacaagaaattcttcagaaaggataaaaatgacataggtcggaaaatctaatttacataaagaaatgaaaagcattggagaagaaatatatgaagaaaaattaaatatatatgtattttttgattcataattgatctttcaacaatttgttcaaaataataacaagattatatttggtgattataggttatggaaaagtgaaatgaatgacagcaatattataagtcatccggttccaagatggccgaataggaacagctccagtttacagctcccagtgtgagtgacgcagaagacagttgatttctgcatttccaactgacgtaccaggttcatctcactggggcttgttggacagtgggtgcagcccatggagtgtaagccgaagcaggacgaggcatcacctcacctgggaagtgcaagaggtcagggaattccctttcctagccaagggaagcgtgacagatggtacctggaaaattgggacactcccaccctaatactgtgcttttccaactgtcttagcaaacggcacaccaggagattatatcccgtgcctggcttggagggtcccacatccacggagccttgctcactgctagcacagtagtctgagatcaaactgcaaggcagcagtgaggctgggggaggggcatccaccattgctgaggcttgagtaggtaaacaaagcggctgggaagctcgaactgggtggagcccaccacagctcaaggaggcctgcctgcttccgtagactccacctctaggggcagggcatagcagaacaaaaggcaacagaaacttctgcagacttaaacatccctgacagctttgaagagagtagtggttctcccagtacagagtttcagatctgagaacagacaggctgcctccttaaatgggtccctgacccccaagtagcctaactgagagacacctcccagtaggggctgactgatacctcatacagctgggtgcccctctgagacgaagcttccagaggaaggatcaggcagcaacatttgccgttctgcaatatttgctgttttgcagcctccactggtgatacccaagcaaacagggtctggagtggacttccagcaaactccaacagacctgcagctgaggatcctgactgttagaaggaaaactaacaaagagaaaggacatccacaccaaaaccccatctgtacgtcaccatcatcaaagaccaaaggtagatgaaaccacaaagatggggagaaaccagagcagaaaaactgaaaattctaaaaatcagagcacctcttctcctccaaaggaatgcagctccctgccagcaatggaacaaagctggacggagaatgactttgacgagctgacagaagtaggcttcagatgatcgctaataacaaacttctctgagctaaaggatgaggttcaaacccatcgcaaagaagctaaaaaccttgaaaaaagattagatgagtggctaactagaataaacagcatagagaagaccttaaatgacctgatggagctgaaaccatggcacaagaactacgtcacacatgcacaagcttcagtagccgatttgatcaagtggaagaaagggtatcagtgattcaagatcaaatgaatgaaatgaagcaagaagagaagtttagagaaaaaagagtaaaaagaaacaaagcctaaaaaagtaaaaaagtaaaacaaagtaaaaaagaaacatgggactatgtgaaaacaccaaatctacgtctgattggtgtacttgaaagtgatggggagaatggaaccaagttggaaaacactctgcaggatattatccaggagaactcccccaacctaggaaggcaagccaacattcaagttcagaaaatacagagaatgccacaaagatactccttgagaagcgtaactccaagacacataattgacagatacaccaaagttgaaatgaaggaaaaaatattaagggaagccagagagaaaggtcaagttacccacaaagggaagcccatcaaactaacagcaaatctctcagcagaaactctacaagccagaagagagtgggggccaatattcaacattcttaaatgaaagaattttcaacccagaatttcatatccagccaaactaagcttcataattgaaggagaaataaaatactttacagacaagtaaatgctgagagattttgtcaccaccaggcctgccctacaagagctcctgaaggaagcactaagcatggaaaggaacaaccagtaccagccactgcaaaaacatgccaaattgtaaagatcactgatgctaggaagaaactgcgtcaactaacgagcaaaataaccagctaacatcacaatgacaggatcacattcacacataacaatattaaccttaaatgtaaatgggctaaattctccaattaaaagacacagactggcaaattggataaagagtcaagacccatcagtgtgctgtattcaggagacccatctcatgtgcagagacacacataggctccaaataaagggatggaggaagatctaccaagcaaatggaaaacaaaaaaaagcaggggttgcaatcctagtctctgatgaaacagactttaaaccaacaaagatcaaaagagacaaagaaggccattatgtaatagtaaaggggtcaattcaacaacaagagctaactatcctaaatatacatgcacccaatacaggagcacccagattcataaagtaagtccttacagacctacaaagagacttagactcccacacaataataatgggagactttaacaccccactgtcaacattagacagatcaacaagacagaaagttaacaaggatatccaggaattgaactcagctctacaccaagcagacctaatagacatctacagaactctccaccccaaatcaacagaatgtacattcttctcagcaccacatcgcacttattccaaaattgaccacatagttggaagtaaagcactcctcagcgaatgtaaaagaatagaaattataacaaactgtctctcagaccacagtgcaatcaaactagaactcaggattaagaaactcactcaaaaccactcaactacatggaaactgaaaaatctgctcctgaatgactactgggtacataatgaaatgaaggcagaaataaagatgttctttgaaaccaatgagaacaaagacacaacataccagaatctctgggacatatttaaagcagtgtgtagagagaaatttatagcactaaatgcccacaagagaaagcaggaaagatctaaaattgacaccctaacatcacaattaaaagaactagggaagcaagagccaacattttcaaaagctagcagaaggcaggaaataactaagattggagcagaactgaaggagatagagacacaaaaaacccttcaaaaaatcaatgaatccaggaactggttttttgaaaagataaacaaaattgatagaccactagcaagactaataaagaagaaaagagagaagaatccaatagatgcaataaaaaatgataaaggggatatcaccaccaatcccacagaaatacaaactaccatcagagaatactataaacatctctatgcaaataaactagaaaatctagaagaaatggataaattcctggacacatacaccctcccaagactaaaccaggaagaaggtgaatctctgaatagaccaataacaggctctgaaattgaggcaataattaatagcctaccaaccaaagaaagtccaggaccagagggattcacagctgaattctgccagaggtacaaagaggagctggtaccatgccttccgaaactattccagtcagtagaaaaatagggaatcctctctaactcattttataaggccagcatcatcctgataccaaagcctggcagagacacaacaaaaaagagaattttagaccaatatccctgatgaacatcgatgcaaaaatcttcaataaaatactggcaaaccgaatccagcaacacatcaaaagctaatccaccacgatcaagttggcttcatccctgggatgcaaggctggttcaacatacacaaatcaataaacataatccatcatataaacagaaccaaagacaaaaaccacatgattatctcaacagatgcagaaaaggcctcgacaaaattcaacagcgcttcatgctaaaaactctcactaaactaggtgttgatgggacgtatctcaaaataataagagctgtttatgacaaacccacagccaatgtcatactgaatgggcaaaaactggaagcattccctttgaaaactggcacaagacaggaatgccctctctcaccgctcctattcaacttagtgttggaagttctggccagggcaatcaggcaggagaaagaaataaagggtattcaattaggaaaagaggaagtcaaattgtccctgtttgcagatgacatgattgtatatttagaaaaccccatcgtctcagcccaaaatctccttaagctgataagcaacttcagcaaagtctcagaatacaaaatcaatgtgcaaaaatcacaagcattcctatacaccaataacagacaaacagagagtgaaatcatgagtgaactcccattcacaattgcttcaaagaataaaatacctaggaatccaacttacaagggatgtgaaggacctcttcaaggagaactacaaaccactgctcaacgaaataaaagaggacacaaacaaatggaagaacattccatgctcatggataggaagaatcagtatcgtgaaaatggccatactgcccaaggtaatttatagattcaatgccatccccatcaagctaccaatgactttcttcacagaattggaaaaaactactttaaagttcatatggaaccgaaaaagagcctgcattgccaagtcaatcctaagccaaaaggacaaagctggaggcatcacactacctgacttcaaactatactacgaggctacagtaaccaaaacagcatggtactggtaccaaaacagagatatagaccagtggaacagaacagacccctcagaaataataccacatgtctacaaccatctgatctttgacaaacctgacaaaaataagaaatggggaaaggattccctatttaataaatggtgctgagaaaactggctagccatatgtaaaaagctgaaactggatcccttccttacaccttatacaaaaattaattcaagatggattaaagacctaaatgttagacctaaaaccataaaaaccctagaagaaaacctaggcaataccattcaggacataggcatgggcaaggacttcatgactaaaacaccaaaagcaatggcaacaaaagccaaaataaacaaatgggatctaattaaactaaagagtttctacacagcaaaagaaactaccatcagagtgaacaggcaacctacagaatgggagaaaatttttacaatctactcatctgacaaagggctgatatccagaatctagaaagaagttaaacaaatttacaagaaaaaaatcaaccccatcaacaagtgggcaaaggatatgaacagacacttctcaaaagaagacatttatgcagccaaagacacatgaaaaaatgctcatcatcactggccatcagagaaatgcgaatcaaagccacaatgagatcccatctcacaccagttagaatggcaatcattaaaaagtcaggaaacaacaggtgctggacaggatgtggagaaataggaatacttttacactgttggtgggatggtaaactagttccaccattgtagaagacagtgtggcaattcctcaaggatctagaactagaaataccatttgtcccagccatcccattactgggtacatacccaaaggattatatatcatgctactataaagacacatgcacatgtatgttcattgtggcactattcacagtagcaaagacttggaaccaactcaaatgtccatcaacgatagactggattaagaaaatgtggcacatatacaccatggaatactttgcagccataaaaatggatgagttcaagtcttttgtagggacatggatgaagctggaaaccatcattctcagcaaactatcgcaaggacaaaaaaccaaacactgcatgttctcactcataggtgggaattgaacggtgagaacacttggacacagggtggggaacatcacacacgagtggctgccgtggggtggggggaggggggagggatagcattaggagatatacctaatgtaaatgacgagttaacgggtgcagcacaccaacatggcacatgtatacatatgtaacaaacctgcacgttttgcacatgtaccctagaacttaaagtatgaaatatatatatatatatatatatatagtcatgagggagagaaaatactcttagttacttggactaacccacgaagtaggacagtataatttgaaaaaggacttggattagttgtaaacgtataatgtaatatccagcacagccactaaaaatgattttgaaaaaagcagtataatcaatatactaacagaagaaaaagcagaatcaggccagacatggtgactcatgtctgtaatcccagcactttgggatgctgaggcaggaagatcacttgagccccggagttcaagtccagcctggcaacgaataagagcccatctctaccctccaccccccccaaaaaaaaaaagaaaaagaaaaagaggccgggcacggtggcttactcctgtaatcccagcactttgggaggccgaggtgggtggatcgcgaggtcaggagatcaagaccatcctgcctaacacggtgaaaccccgtctctactaaaaatacaaaaaaaaaaaaaaaatagctgggcatggtggcgggcgcctgtagtcccagctactcaggaggctgaggcaggagaatggtgtgaacctgggaggcagagcttgcagtgagccgagattgcgccactgcactccagcctgggagacagccgcaagattctgtctcaaaaaaacaacaacaacaacaaaaaaaaacaaaaacaaaaacaaagaaaacgaaaagaaaaagcagaatctttttttttttttttttttttttttttttgagatggagttttggtcttgttgcccgggctggagtgcaatggcacgatttcagctcaccacaacctccacctcccaggttcaagcaattctccgggctcagcctcccgaatagctgggattacaggtgtgcaccaccatgcctggctaattttttgtatgaaaaagcagaatcttatacaatgctcaattaaaatcagggagaggagaaaaagagtagaataccaaaaaagtaacaaattacaaggttgatataaatagaaaacaatcacaaatactgagtatactaatctaagtatatcaataatcactttaaacatcgcttaaaagacagagattgtcagtggattaagaacaagacccaaatatatgttgtctatgagaaatgcactttaaatagctgggcatggtggtgtgcacctgcagtccttaggaggccaaggcggagtgtcacctgagcccaggattttgggactacagtgagctatgatcatgccactgcactctagcctggttgacagaataagacctcatctctatagaaaaaagtaagtaaatctactttataaaggcacaaatatattcacagtaaaggaatagagaaagatatcccatgctaacattaatcaaaataaagtgaaatagccatattaatttcagacacaaccgactttagaacaaggaatattatcagagatcaaaagggacattccttaatgataaagggatcagttttctaagaagacataacaatccttaatgtgtacgcactgaacagcagatcatcaaagtacatgaagctaaatctgatagaactgcatagagaaatagataaattcactcttagagttggaggcattggcatccctctatcagaaatggacaggtttagcaagcagaaaatcagtaagggcataacatgatcaatcatgatcaaaaacttgattcagtcaactatatgtaactgacatctatggaccactttacccaacaacagcagatgacacattttctcacacacacatgaaacattcagcagaatagaccacattctgggctagaaaatgcacctcaacaaatttaaaagaatagaaatcatacaaagtatgttctcagactacaatggaatgaaagtaaacaaaaatcactaaaaaagatagctgaaaaacatgaaaatacttggaggttaaacaacagactgaaataactgaaggtcacagaagtctcaagataaatttttaaaatatttcaaactaaatggaattgaaagcacaacttatcaaaaatttaggaacgcaacaaaggcagtgcctactgggaaatttataccactgaatgtatgttaaaaagaacaaagatctaaataaataatccttcccattggaaagctagggggaaaattcaaattaaattcaaagtaagcaagtaaaagaaataataaaatatgaatacaattctgagtggcctgatatctgatttctggaagctgagttttatgtggctttagaagtttcatgttatgagtgtgaaatggcaagtgaccatggcgattgcttctgatatggccacctcaattacatagagaagggatgatcagtggcatcatcccagttctgcatgataccacaccagtgattctccaaagtcaagaaacctgtatatgttgtccttgtgtttggtgaatctgtggtctatagactacataatgggctatttctggggtactgaccattttgctccattaaggaaaaccatgcatgagccatataactatgggaaacaatgttttcctttttgacacctggcctactctcttcttaggtgagagcaaaggaagagcaccacttggcctgctgcacccagggcaatttataccatccagatatccagcactgaatatgtagcaactccaatccaccatagaacattaatctatctctgataagcatgctaatatctatgattctgcctttgtggggagatgactccatagattaaccccctggcttggggcaatatggagatgttatattgtcttcgacagggaagatgacataaaaattatgttcaataggattatgtggagacttaacataagtgacaaacctaagacaagaagttagaaatccttgtttcttttaggtgaataattttggagcttgagaaaaagacaccattgtggcgaacttgctttgccaaaccctgtgtatgcatttttgggtaaacaacacattttcatcctttaagcattgtttccattatttataattcctaatagtatgagacatttaggactcattccttggttcttcttctctcattgtatctttcattgtatctttcagtgctgcaagagatgcaatcatcccattaatgaaagcagagtgactgccttcgtcacacatacattcaaaatagatcactaggctagtgatgattctctcttaaggctattatgtttactcatttaaaaaatctggatctcagtatagattttcttctcagtgagtgactgacctatctgatatgatgctatgacaaaatctttactttttacctgaatttggtgggattgaaagttgagaacatattaatttattttctgtttcacttgattaataatgcccaatctaacatgcagtgttcacttgggtacatatatacaactacatcaaattttttcttgttttaccttaaaagtgttaagatattgtaatggtatggccagtttactcactggtaaacttttcataacagaaatatcatgccagtggacacaaatatgtaacatcagtaatttgctttcctcatgaaacagagaactgaataagttgatgggtaaactagtatctgaattataaaccccaaatatcatgtgacttcatcattttcagtataatgaaaatacaggctgtgaatgcttccagttggtcctgaaagggcctttgaggtgagtaggttcaccaaagcggcaacatatgtgtcccagtgggcattctactcctcagtaagtgacttgacattctttatggcttcctcatgattaaaacaagtctttttattgaaattttactgaaataatgatgaaacaatgtaatattcttttcatctacatataagagtagacatagattaacctctaccttttttttttttttttttgagacggagtctcgctctgttgcccaggctagagtacagtggtgcgatctcagctcattgcaacctctgcctcccaggttcaagcgattctcctgcctcagcctcctgagtagctgggattacaggcacgtgctaccattcctggctaatttttttgtaattttagtagagacatggtttcaccatgttggtcaggctgttcttgaactcctgaccttgtgatctgcccacctctgcctcccaaagtgctgggattacaggcttgagcccccgtgcctggccttcacctctacctattataatattttcatgttattccattttgtcatgtttgtgggtcatttgatgagggttcacaatatgaaaactgggcattttggccaagatgcatgtaaatgaatacaactccatgtgccctgataactgatttctagatcctgagatgcaagtggcttccagagtgtctgtattttatgaaagttcatatacagtaaaccatgctaattgttactgatacagcttccttgaatatataaagcgatgattaatgggatgttttgtttctgcagaaaaccactgaattgcttctccaaagccaagtgacctgtatgatttgtccttattatattttgtgaaccagtggactaaaacctttataatgggtcatttttttagtattgtcaatattgctcaattaacaaacatgactcatatacacaggtgagatgtagttctccctttgacatttgctctacatctgtcccttagatgatgatatggaagaaaagcactctttggcctgttgtgactgggacagttgacagcacccaggtgtcctttaatgaaaatgctcttgacaccaatgcatcctagcatcacagcttcaggaagccttctcaagtgtgcatggggagtactatgtctttcatcaataatgaaatcttctgatttggtgagaaataatgccttaaaattacactcaataggattatgctgaggctcagcctacctagatgaaaatgctgaaacagataatagtgacttcttatttcccttcaaggggaattttattttgaacttgaaataacaaaatctttatgggtaacttgtttgcccaactgtatcagtgcacctataaatgaacaaaaaattctcagcctataagctttgcttcagtgacctttaatttctaatagtaaggtatattcaggtctcattctttggctttttctcttattgtgtatttcagtaagacatgctgccaagagatgtgccattctattataaaagatcagtagcttcctttaccgacgtgtatattctatctagaacattgagctatggaagactcccacctaagggaattagttttacaccttcaggtaatctgaacttcaatatgagttttgctttatgatataatccttatgacaaaatctttactttttatctgaacttcatacaatcaatattgaagattttttaaattcactgttacctagtccaatatttaatatacatttggctgtagatacatgactagacaaaaattttttatattattattgtgggggctctaacagtgtttcactgttttgagttactgatgaactttctgtaactgtgagaccatggtaatggaagagaccgtggtaatggggaggagaatgtgaggatcagtatgtactttgcctataaaacttaaatatttagtaatttgatcaccaaattgatactcaaatttcagttcctatcatgtgtaaaccaaaaagtatctgagatttagaagtttatttagaagtggattttgccaaggttaagcacatgctcagaagaaataaacccaaaatcacagaaaccgtctggggtctatgtctttctccaaagatgattttgagggcttcagtgtttaaaggggaaaagtgggctggagggggaaaagggagggtatgataatccgtatgttccaagacaaaaggagcaggtaggggtatagtcaataatgtattcatctcatgctcagtaaatcagcactttacataagataaggtgaacatagagaagctacctgtggagatctttaacctttaatctgtagctatctgcttaagatcaaaaggaaattcttgcatgactcagctttcagcttattttttttttctcttggcgtagtaaattggggtcccaagtttattttcctttcacacatgtgaccccactattttcagaataatgaaagcacatgttagaaatgatgacacttattcctaatatggactttgaaatgactgggttcacaaatttagaatcatggatctcattataggtttttattttcaatgagtgactggcctacttgatggaattctttcaaaaaatgttcactttttactgagattatattaaaataatgttggaatgtgttcagtcatgtttaccatctctatagtatgatatatgataatatcgcagattactcagtgtcaaaaacctggcataccttgtccttatgatgttgatgagtcaatggtctagagccttagtaatatgtctttttgtggtagtacggaccgtatctgtccactaagaaatagcctgtgtaagccatatacacatgaacaatttatgtctgattttgaactatggtcccattcctatgcctgtagataaagactgctgagaagagcaccctctggtgttgtcacagaggcaagtgctaccgcacaggcatgctgcagtgaatttaactgatcctctgtccctgcaaccgttgtttaaggatgctattctggtaagggtttacaagacaacgtaaatatatgtataaagagtatcttcaggagacgtaataatgtaaaaatcatgctcaatagaattaagctgaggctcaaaatagtgccaatccttgcaagaaggtgtgagaagtcattagatttggggggtatgggttattccattttgaacttggtaggaagaaacccttgggggaatcttacatcatttgcctctacctacttctaaaggaacttttaaaattcttttatcttgtctttattcttaatactcatacattattagagagaatatcttggtttattttttcctcatggtgtgcttcagaatgttcatccagcaagaggtgtgtcattacacggattatatatatgagttctgtctttcgtaattaaaaaatttcaagtggaccatttgaatattaaacattggccttcaaaatgattacatttacctgttcatacaaaattagtgagcaatgatctattctttccaatgagtgactgatctaatgaggtcctcattaaaactccttttttttttttttttttttttgcctgaacgtactttgatttaaagatgtgacatttagtaattcattgcaatcaactctttagtgattgcacaaatagacaatccttttctattattttattttttggttgctgtgtatggtgttatgatgtttgtggatcattgaggcactactcacaactgaaagactttggcaattttagggaatggcttgagattcagctataggttacccttgattgaaattgaatacaatacaggtagtctgaaatctcatttccttatcctgagtctcactcaggtgtcattagattcattataaagaaatgcatacactatgtatgatgccagttgttactgatatgaagacgataagaagcttttatttctgcagggaaataatcccttaccaggtcatcaaaagacatgatacctatgtgcttggcccttactgtacacggggaatcagtggtctaccacagcttaagtaacgggtcatatttggagtatcacacatctcagtcttgtagaaattaggaacagcaattaggagtcatgcacatataagagatgtaatcccaccctttgactatagcctactcttgtcttttacagaaaagactgtggaggaagaaaaccctttaccctgttgttcagggagaaactgacaccactcaactgcctggcactgaaaatgtggcatccagtccactttaccatcagtgtttaaggaaaccatctctggtaagcatatttgatccaagtgtgcatatgcacatgagtgccatgggctgggtcaatgatgagatgttaccttgaagagaaatgatgacgtaaaaattaagttcagttggattacgctgaggcccagcctaggtaacaattgtgagacaagaagtttggatttcttagtttccttccattggggactttattttgggattctggcaatggaatcttattgcgaaacttgttttgcacgcttctatctgtgtgcttctaagtaaactataaattctgattctttaagtgctatttaagtttcctacaattcctaattttcttggatatttggcactaagacccttgctctttttctctcattggatgatttagtaagtcctactggcactattctattgagtggaggtgagaggctgcctttgctgactgaaaaatttcaaatagataattgaactagtgaagactgagctctataataattagatttattcattcagacaacatgaatatcacgatagggttttcttctcaatgattgactgacacatgtgatgcaatcctcatgagaaaatccttacttttgccctacgattgattgttttcagggttgagaaatatgatacattggaattttgctcaatgcgctacagttatcgtggtctaaatatacagacaaaattttctgtaatgttagtataatattttaacagtgctaggatatgttttgatcattaatgaatctttatgacttaagggtccttgcaattgggataaaaatgtgagtttcaataatatgtgtttgcccatgaaacttgaaattagataaattgatgagcaatctggtgcctgacttttctttctcaagtacctttggcttcgttttcattatgatgaaagtgtgtgctgtgaataatgccaatggtaaataagacctttatggacacttatatgaatgacagtcagggccgttccttcaggccacatgattatcgttatgcattcttcttctcaatgagtgactagcatacttgccaggatctacaagagggaaactttattttttactaaaattgcatcgatataatgttgacaagttttgtgattattggtatcatctctaagatgtgatgctcatttggtctaaatatagaagttaacatattaacttctaatttatatatgtcaggttgctatgtttttacaatgtttgtggtttattgatgatgactcacaacataaagactatggcattatggctacatgttctaattctgatatatacatatcccatcattcattaaattaaatacaattatgagtagtatgatgtctgttttctaaaatctgagtttcacctggctccagtatgatcattatatgatggagtgcaagcaacatgttaatgccaattgttattgatatggcttccttgaatatgtaaacaagactgatcaattgaaggtcttatttctgcattaaactacctgagatattctccaaattcaagagacctgtatagttagtctttattctgtttgatgaataaatggcctatagcctatctaatggatcagtttttccagtactaatcatatctcttcattaagaaatagcatgcataagccatacatacaggaggtaatatttgtcatcttgatctactgtcttatcctcctccccttagataaggatgactgaggaagagtactctttggcttgttgacaccagcacagctgacacacccagatatctgtttggtctcctgtgaactttcaaccaggatttaaggatgccactctggtaggtattttcagacaaagtgaatatgtgattgtagagttccatggcttgtttcaacaataagaccttatgttgtcttgaggacatgagatgacatgaaaactagactggctggtccttatcttttctggggtattctagtttgagcttaagataaagaaatatatttgggatatagtttctctcacctgtttctattagcttctagaagaccacttatcaattctttcctcctgatttagtggaaaacattttggcagttcctcaaaaagttaaagataaaattaccatgtaacccaacaattctgctcctaagtacacactcaaaagaattgaatacaaatgttcaaatgaatacatacacatgaatgttcatagcagcactattcactggctggagttccagaccagcctggccaacgtggcaagaccctgtctctactaaaaatagaaaaattagctgggcatggttgctcacgcttgtagtctcagctactcaggaggctgaggcacaagaatcacttgaacccaggaggcagaggctgcagtgagctgagatcacaccattgcactccagcatgggtgacaagtgagattctgtctcaaaaaaaaaaaagtgaaggtatgatgacaatgtcacacaaaatagtgaataccaataaaaagatagaaattattaaaaagaaccaaatgaaaattctggagttgaaaagtacaataactaaaatttaaaaatttattagaaaggctcaatagtagatttgaactgggagaagaaacaagaagtaaacttgaagatagaacaatagagattatgttcaaaagaacagaaagcataaagaataaagaaacaaagagagtctcagagaatgtggaacatcattaagcataccagcatacacatatgggagtaccagacaggcaggggagatacaaaggatcagaaaaaaatatttgaaggaataatggctgaaacctcccatatttgtggaaaacaataactgacatatccaggaagctcaatgaattccaatgaataaatgcaaagattgacaaatggaaacatcacagtaagatatctgaaagtcaaaaacaagaagaaagtcttgaaagcagtgtgagaaaaatgatttgttacttacaagggaaccccaggaagattaacagctgacttcagcagaagcaatggaggccagaagcaaaggcataacatattaaaaatgctcaaagaaaaaagaacctgtcacctaagaattctgtacctggcaaagctgtctttcaaaaatgaaggcaaaataaagacttcctcaattaaaaaaaaaaaagttggagaatctactgctctcaaaacccccttaaaagagttctctaaatacttaaagaagttattcaagctgaaagcaagtgagcctaggtagttattcaaatcaacaactacaaagcaaatgcttgtaaaggtaattatataaatataaaagacagtagaaatgtaatttttctctgaagtgattttaaaataaattctataaaataatatgtatataatgtattttggggtctataacatataaaagtgtaatatatttgccaaagaagataggtggatgcaaagcaatacaagactaaggaaatgactacagatggtagattaatatttattataatgtctttcttggcttatagcatcaataaatgtaatatgtataataataccacaaaagatggcaaaaagggaatagagctatataggtgtaacatttctgtataagactgaaattaagctagtgtaaattagaaacttatttgggtgagttaagatatatgcagtaaaccctagagcaaccactgaaaaaattcaaaacatatagtgaaaaaaattattaaggaagtttaaatgctacattataaaataattacttaatgaaaaagaagtaaagaggaatagaggaacaaaaacacatgagacacagaggagaagaagaatgacataataaactcaactaaataataaaattacatgtgaatacagtaaatatgtaaattaaaaggcagagattcccaggctggataaaatctccaggtttaatatccctttgccccaaataaactccagctttttttcctatgatgtatttgatcattgtgctggtttacaaaagatttctaacctttctaaaatctttaaaatcagcggcgaagtgttctatctcatttcacccatatatatcagagactcaaatcctgaaaaataccaagttgacctgcccattcttgagttctgctgaatggtgtgttcccagatcactatggatattgctgtttacttgaccaattacttttagtcaacaagatttgaacaatgcttttgattcacacagcgtgagacctagacttccctcatattgaaataggagcattagcatcctggattcctgcaccggcttttgaaccttatgtttcctgcaccccaagaagccatgttatctggacattgtcctctctgtgatgggaaagaagagttttttcaacaaatgttgctaggacaactggatatctagatacaaaagatactgcatttatgttaccagttttctgtgtcagtccattttgctctgatgtaacagaatactgcagactgggtatttgtaatgagtggaaacttattggctcacatttctggaggctggaaagatcaaggggctggcatatgataagggccttctcactctgtcatcctatggtagaagggcaaagagagggtatggatgggacaaatatcttcttttataggaacccacccctgaaataacagcattaatccattgatgagggcagagctctcacagcctaatcaccttttttttttttttttgagacggagtctcgctctttcgcccaggcgagagtgcagtggtgctatctcggctcactgcaggctccgcctcccgggttcacgccattctcctgcctcagcctcccgagtagctgggactataggcgcccgccacggcggccggctaattttttgtatttttagtagagacggggtttcaccgtgttagccaggatggtctcattctcctgacctcgcgatccgcccgccttggcctcccaaagccctgggatcacaggcgtgagccaccgcgcccggccgcctaatcaccttttaaatgttgctttattaaacactgttgcattgagggttacgtttccaagacaggcttttgaagtgaaatgaaaaatttgaccattcccaattatagtttgaaatttcaatgctcctttcttagtatgtgattgaacatggataagataatcagtaacggtggatgtaagaacactattaaccaacttgactccactgtcatatgtagaacacaacacccaacaatagcagaatgcacattatattcaagtgctcataaagcattattttgtatatatgtattttctcccttttttgataaagttagctagtagagtgcctatgtagttaatattttttaaaaaccacaggcttctcaattattaattacatctatggtttttaaaatattatcttcattaatttctgctttgatccttattcctttctttcttgtactttcttttatttttgttcttttttagtgttttaagatgaaaattgaattgtttcattcatctttttcattttttaaaataaaaacatttagtgcaatgaattttcctctagaactgcctttaaatgcatattacagattctcatatgttgtatattttaaaataatatgtaaatatatatttgcatagaaaaacatatttacatacaaaatatgtatttacatatttaaacatatgtattttctgtttatatttttccttttactcaggagttaataggatatttttaaaatttcttggtgaaagcgcctttatcttattgttagtaaagtctatgtttttgcattgtgatcagatagtgcagtttttaatatttcttgagttactaatttttctttccaacctaatatataatcagttttttgtgactatgccatgggcacttaagaacaacacagatcttctattatctgtcaagtttaatatgtagccataaaatctaccttatttttatgttgctatttttgcccacttgatctgtctttttctgataatggtgtattatagttttctattatgggatcatctatgtcttgtctccttacatctcatacatctcatgcagttttttattcataaaggtggttattatgttatttggtatataagtctccataagggtcaaatcttcatgtgtattatatcttttagcataaaaaaagtgtccttctttgccttgattaacatggtgggacttgaatacattgtgtgatataagaattactacgcttgcatgcgattggcatgaaaaaaaaaaagattactcctatctctttttgttttcatgtgcctgatatactttcgcccatccctttattttcagtcttttagaatccatttgttttagattcatctctcatagaaaacatattatgttttattttgtgagcccactgaaaatatttttcttctagtaggtgtgtggagtccactcacgtgtgtgtgtgtgtgtgtgtgtgtgtgtgtgtagctatgactgatatttattgtgtttgtattttctttatatttgctacgctcttttgtcacggtgtagtctttgcttgcctatttattcatacttaggagagtttttgtttttgttggagtgtttacttttgtacctctcttaattctgttagttctgtgttttcctagttaatcttttacttctgatttatcagtttgggggatgttcttcagcactcccctattctcatgcaaagtgctttcggttttcctctttttttttttttcctcctcctgtgtttagttgtcttatttctactttgtcacaatattagtgacatttgtatgctagtcttctaccctggatagggaatatacacctgtcagatggaaggaatatcatgttgtatgctgctgtcaaatagatcctaacatactttaataatcttttaaatgatataatccaagttcatagttaactcctgactttttatttctatcatattcagtagatatatcagcattgacagccatcccactgcaatatcacttcacattttgcttagaccaaagggttctgagaagcttctggagctgttgtgaaagccagtttcattaaagtcaagtcagacatccacctgtgctgttttctgctataagctgaatgcaggggatacaatgttaggagcatcagtgtggtatgaggaatgtttacttattggtagtagacttgtctggatcaaggataagtacaagtatctgagatgctgaggtgtggctgaatgaatggccatctgttctattgcaacaggataaataacacattcggagcaggcctaactggtgaactcctcaattatctcacaatagcactatcacgtgtctttcatttttcacagcacagtgtattttcataaaatctttattggtagaccacaactttagcatttcccattcaagatacaactactgtgtcacttggatagcttggtagagaggaaattggctattttcagagtaaagaattcaaggaggaaacagattataaatgaaatgacaaaggtgatgagatcaagcaatgctgacgtttgtagcaaggagtagagggctgagatgcctgtatgataagaaattataatggaaccaatcttgtgctttattttttattaatttggagcattctctgatctgatttattttctatgtgatattttgctgcaggttaaaagctgaaacaacttcaaggaaacttcagggaaaagaggtgagcagccactttggtacttttgaaattctttgttctgtgggcaatgatgtcagaatgtcaaagactgtgagttcattatttcagaggcttaaaggagattattcttttggtagatatatttccccatgggtgtccctaccttgttcaaggattccttattattgtttcttctctttgtttaaatctctttttgagatgacctaaacaactgtggagaatcattgatatatttccttttttcactgttcatgttgggtgaaaataatcttgtagtgaaattcacatgttctaaatattgtttttttacatctttatctggcacattcataacatagatgtttctatacatattagtactgtaatcataccatatattattctgttaccccacttactccttaaacttttagttaattaaagagtttttataaagtcccccaatagattttttttttttgagacatagtctcactctgttgcccaggctggagtgcagtggcgtgattttggctcactgcaacctccccatcctgggttcaagcaattctcctgcctcagcctgccaagtagctgggattacaggtgcctgccaccacgcccgactaatttttgtattttcagtagtgacagggtttcaccatcttggccaggctggtcttgaactcctgacctcgtgatccacccgccttggcctctcagagtgctaggattacaggcttgagccactgcacccggccagattttaatctaattttattagaacaattcagtcatatgttttttcatgctatgtatatgagagttccattattcagatactaaacaaatgtctactgtacatttactgttctcactgatgatgcattagataaccatgcacaaaataagcctggctgtggaaacgcttatttgttgggagggtgcttgtttggatcgatgatgagaataattgtctgaggatgctgagggactcattccagatgtcaatctgaggtccagatgtgcggccctccaataggacaaataagactctcagagcctggctctatttggggatccctcagtgacaacatagtacccctgtgagcgtgccttttctatctcttcgaagagggcagtggcatcctgtcttatgagtcagtgtgcactttagtgtgcctagtgacccaagacttgctttaattgtagatagatacttacatataggaaatatttcttaagtaacaaatgaaaaactttagaagattgaattaagggtcaagcaactgtgatatgtctgaaaatctcattagtgttgtgctgaaagaaggaaatatggcatgcctctattaaataatgacagtggaaccaagtttattgctttgttatttttactgtggagtattttctaagattatttttgctttttttttctttcatgttttgctgagatagaaggcctggaatctgatcctccacttcagagaacaggggtgagtagctaagccattatcttttgaaattcatatgtcatgtgctctttgctaggtctttaggtcgttttgtacatcttttcagaagcttattggaggacattttcatgatatgtccttttcctcattgagaccctcaccatgtcacctacactattgaatccttatcatttctcttttaattttaactctcttttgcttttatggaaaaatgtagaatttaagagaatttttggcaatttcatattggatcaaaatgtattgtagtgaaatccaggtgtgccaaaatattaacagattttccccatctgtttaattattggggtttcagaatagagactccatggttcataatatctttgtggtcatactacattatatttctgcttctaatttaattattaaatattgacttgaattagtcttttcctcattgttgcaacaaggtaagttatataggaaattttcttctcttgatggcatgtctgagataatcatagatataagacacctggctggtttctagaatgcatgtaatttttatttcttgatctgtgtgttgagtacttgctgtgattgcatcatgcaaatacattgagctttacaattttagtgtatgcacttttctacatgtatattattcttcgatagaaagtaaaaaaaacttatcgaactagtcaaaatattggttaatacataaaaaaagtctcaagtagattgtgtattacatggtgcttgttgattgatgccctcataatagatcaagtgggttctctctttagcacagggctttttagcaaatcatgtcatgagtagttactcaagtatttttattttaacacatttatattttttctatgtatattcttaaattctcttatacttttttctctgttataaaaacatgctgaacaatctcaagtcttaaggattgcagtattgtccccacatattcatgtattttggtactcaattctttatactttctttgacagatcacttgaactggcacatgtctcttgttttgcagagagggaattaatgtgataccttcatgcttttctattctatgtgctacataattgaatatacaagcaaatatagttgttaagatttagtgtgattatttctacaccacatgcaaagaagtttctcatagatcttaatagaggcccacatgcattgtacagtttagaatttggggaaatattgatgaagttgggtaaagtataaagccaaaagtcagaacagtgaactccttgcttaaggatttccttggagattacttagtcaatacacaactgataaatttaagtgcttttcaccttttgagttctcgacatactaaagctaaaatgtgtttcaacttttaatcctgcttccctgattttcccttttttagtctgagatcaaagagtttcagccataaattactgccaagagtaatcacttcattttaagaaagcttaacaatatagaagaatataaaattatttatgacagatgtatttttaaccttttccccatgctttccagaggaaatatgtttaatcatctgccctatattagggaaaaactttctatgctaatacaagtatctatcaatccatttatctttctatataagatgtattgatcataaccaattaactttactgtaaatgagctttagatttgacattttggtagtaatatatgttgtacaatctcctgaggtcctataggtcttgaggtctctatgtcaaaaactatagatgtgccagtgtcctcagtgaatgtgaaggacaccacattttccttagccatttcttgttttcagaataatggttatcaacattttgctactgcaagataccatacatttataatcggaatatgccagtttttatgcactcatgcctctgtttctgtagagcattcccagaatgagtaatgcttgaaaattaggtccatgtgatttctttaatgagttatagtcaaatcatgaaatattcaggttaccattatttcagtaatgtattagaatgtcaaggtaaagttatctacattgtatatatacacacaacatagatataatttatacaacatctatatttatacaacagatatatatttatgtatatatttatacaacataaaatatattttattatttaaacataaaatatattttattatttaatatagattcttaagtgataaatatgtttaatattattaaaataggttaaaataggttatagttagtacagtgaaaattggcagcccttttacaaaacatatgccataactatagcatttatcactgacagtcataccaggatagtcttttatttccaatcacttaaatattcctaattgcaaaagaaatttgaagactaaaattcagaagttttgaaagagccattgcctgggtaaactatacaggtttcagttttatttataataattatgaggccaggcgcagtggctcacacctgtaatcccaacactttgggaggccgaggcgggtggatcacgaggtcaggagatcgagaccatcctggctaacacggtgaaaccccatctctactaaaaatacaaaaaattagccgggcgtggtggcgggcgcctgtagtcccagctactcgggaggctgaggcaggagaatggcgtgaacctggtaggcggagcttgcagtgagccgagatcgcgccactgccctccagcctgggagacagtgcgagactccgtctcaaaaaaaaaaattatgtatatatttataaattaatacttaataaattaataacttgtgataggcaatgcaaagatgacagtaaaaggacaaaattgattagattgataaagtcctgttaacatgaagaaattgaccaggataccatccacactataaagttagagaaatttatcaggacaattccctaaaatactcttctcaattttaacattgtaacaggaatttttaaaattttggtattatgtgtgtttccttccagataatttgaacagattcatatttggtatttttaaaagccatatctttgtccttagtgctggcaatgtattcttgagaatgaacaaataagagatacgtaaaagcataagagaaggtatcaggttgaagtagtcaatcagttatacagaacacaaagaattttatcttgtataatgtttatatagctttatagaagtgtgctgaaagggctataaaacatggacattattatctcattgaaaggtccaatacgtactgaaatacatgcttttattttgaaccaaccaccctataaacgttgtatggcttatttagatgagagcccaggttgtgtgtgtctgtgtgtgtgtgtgtgtgtgtgtgtgtgtgtgtgtgtgtgtgtgtacctgacagggaagcaagaacatcgagttgccaatgcactctgtctatggttagaatcatgctgaaaacatggctcccccagttctggaatgagcccacagatcaagcattccccaaagacatagcaggctcaaatccctgtgtacacaatattttatgattatcttatgtcagtactttcaaagtatacagtttgtgtgaagacaaatccaatgtcatttttcttggctagcctatatgtgtggtaaatccattatttacttacttgcttcctgaaaattacaattagattaacaaactgcagcaaagtgggcatgatgagatagagattgaagtgtaagcttatgttaatgatgcccttggtttggataaacacatctaagagaaaaatggaaaaacacacatggcagggaagccttgatagagccaaaatataggattgtatgtagtaatgcaatccatagatgagcatttggcagtaatattatttttcagatatggataaaaattgcttaggagagtaaagagagacaaagttgaaagcaggtttatagtaggtgttgttttagtgttgatccctttttgctccaataatcaaagtgataaatattgaaaattgattcatgcagcattacttactccattctaatttttatatatgtcaaaagtgccatctcccaaactgtgctatccccttcaggagaagagactctgctgaagtttataaggttgacatattgccagcttcaataatgtaaagatgaagtgtatactgaattcttaatgcaaataacaactctattggaaagtaacccagttatagaagtgctaatttgtcaggagctgccttaccaagatcatgatgagtacagttatctcaggattctgaaagattgttttccgatttcaactagtctagctgaatgttccttgatagaaagagaggacttttagaattggttcaatatgatgacctcctgaattatctcacatagcccgtttgtacatgcctttcttttctctcagaaaatggcactatcataatagctttcttacacagacttcaccttagggttttacattaagggaggggtctggtgtttcatttattttgaagtatttgttgttgattgtgtacagtgcttgagtaaaaaattgaatatagaaacatctagaatatttttttaaaggatcagtgtttataaagtgaattattagtgtcaataatgttgggaaagttttaagagaatataggaaacttgaacattacacaactacaatgggaccaaattgtggggtctcattatagttaatatttatgtatttttttccaattgatttgtgtgctttttttctgcatgtttttggcagatagaatggctataacaagtaacagcatgtcaggtaataaaaataagcagagccctattcctttaaaaatcttcactgatgggagggccataaaataagtcttaatacatttaaagaattaaattcatgtaaaccatgttaatttaattccacaatgatattgaattagaaataagaggaatatctcttgaacatctcctaaatgtttggaaatttaaattagcatttctgacctatttattggttaaaaaagatacaaagaaaggaaaattgaaaagtcttttgaactgaataaaaataaaaatatagaatctaaaactttatgggatactgacaaaacaggatatagggaataatttatagcactgaaatgcctatattagaaaagaaaaaaggttttaaatcagtaaatttgtattttaccttaagaaacttagaaaagaacaaattaacccagacttaagtaaaataaaggcactaataaagataagagcagaaatcaatgaaatataaaacaacaaaacacagagaaaaattgagaaaatttaaaaatagcctagtgagaagatattgataaacttgtaaccagaccaatttaagaaaaaaagtcaaaacacaaataccaatatttgaaaatgtaggagggcaaatcattacagattctatgaatactaaaatgataataaggaaaaattatttaaaaggggcatgtcagccaggcatggtggcttacccctgtaatcccagcactttggcaggccgaggtgggaggattgctagagctcaggcattcgagaccagcctgggcaacatgttgaaaccttgtctacacaaaaagtacaaaaattagctgggtgtggtgttgcacacttgtagtcccagtcacttgggaggctgaggcgagaggatcacttgagcccaggaggttgaggctgcagtgagccatgtttgtaccactgccctccagcctgggtgacaaagtaagaccctatgtaaaaaaaaaaaaatgtatgccaacatttttcaataacttaaatgaaatggaaaaattccttgaaagacacgaactacaaaaactcagtgaacaagtaaataacctgaatagccctgtatcaagtaaattgaatttgtagttaaaagccttccaacagagaaaacttcaggtacctatagcttcatatgaaatgaaaaaaaaaataccaatcctctacaagattccagaacatttaaaagaagggaatatttcccaacttattccatttggacagcaatacccaggtaagaaaaagagacacagaaatttaaaaagaagaatatacattattccttaggaacataaatgcaaagaaatctaatcaaaattttggcaaatgaaatgtagaaatactttatgaccaagtgagagttacccaaagaatttaaggttggttttatatgtaaagatcaaccaatataggaaaatcacttctggaaagtcagagtaagaaactccaaaaatctactcctccataaaaccaataacagccttgatagaaatagttgaaattaattttccaaaactttggaaattaaccaaaggcttacaaaattccagagaacattaattcaagaaaaatggctgaatcagtaagaacagccagctttgtggcattttaatatgaccccttcccatgcttttctccctagtgctgagatagtcttaaaaattagcaggatagcaaccactggagaagaaaggtttggaaatttcccaaaaagttccatccccatagaattatcactatttgacctctaaagcccaatctataggatttatattcatttggactgactcagagctcactcagtaaggaaatctcaatttcaaggtattggtcaaaaagaatccatggcaattgttgactatcacaactgcctgaagtcttggtaacagttgggataaacaagaagctgatcaaaaactgaaaactaaaatcttgggaatgagatatctacaggatgcttcaaaaagctttgatacattcctgtttatctagaaagctacatgcaggctgggtgcagtggctcacacctgtaatcccagcactttgggaggccgaggcgtgcggatcatgaggtcaggagtttgaggccagcctgaccaacatggtctctactaaaaacacaaaaattagccaggcgtggtggcgtgcatctgtaatcctagctactcaggaggctgagacaggagaatcgcttgaacccgggaggcggaggttgcagtgagccaagattgtgccactgcactccagcctgggcgacagagcaaggctctgtctcaaaaaaaaaaaaaaaaaaagccacatgcatgtaattgtttacctctggctttccttttatgctctgggcaagctaaggaagagttgtgaactacctaagtgctgaatgggaaccataacacacacacacacacacacacacacacacacagcaccttagtaaagggtgagaggcatgttagttagaagcattaaaggaaatctctttctagtcattatctgtgcactaacctaactgagcagagacttcagtatccacatactacagggcatataaactttacagaattagtccaggaaaatcatatctaaaaaaaaaaaaaagcagtaacaaaaataaactctgggaaaggggagaatatgatttaaagagttgccacattatacataatatgtctagtgttcaacaaaaaattacgagacatgcaaagaaatagaaaaatatggcacaaagaggataagatgaagtcagtgaaactatcctcgaggaagaccagatgttggtcttactagacacagacattgaaccagctattaaaaatacgtacacagaactaagaaaaacatgtcaaaagggttaaagaaaggtataaaaatagtgtcttaccaaatatagactaccaataaagagatagaaattataagaaaagacaacatgaaaaaatataaagcaaaaaaattagacaattgaaacaagagggcctctattcgcagatttgagcaggcagaagaaagaatcagtgaacttgaagatatgtcaactgagattatccagtctgagcaacaaaggtgggaaaaaatgaagaaaactgagcaacaaagaactgtagaacagcatctctcataccaatggatacataaactggagccctagaaggatgaaaaaaggagaaggaaagaaaacttcccaaattttaagaaaaacattaatttatatacccgagatgaccaataaaatccaattaagataatctcaaagagaccaacacctatacacatcatagtcagcgtgtcaaaagacaaacataaggagagaattcttgaagatagtaagaaaaaaattattcataacatacacaccatcctcaataagtctgacaattgacttctcactgtaaaccatgcaggctaaaaaggcaatgtacataaccaaagtgatgaaataaaaaccttcaaccaatcattctagatccaacaaaactattgttcaaaaagaagaaatgaagacattcctaaacaaaatctcagagaaatgttctctataagacttgtcctaatagaaatgctaaaggaactccttcggtctgaaatagaaaggcactggagagtaaatcaaatccacgagaagaaataaagagaaccagtataagtaactacatgtgtaagtttaaaacaaagtataaatttattttgtttgtaacatttgtcttttcctatttgatttaaaatataatctcaattataaacttgtgttgatggtattatataaagatgtaattttgggttatagcaccaaaatggcagaataggaattttctgtaggtgtttcccacataagtatcaattttgacaaccatccatgggcaagagtaccttgtgggagttcaggagttgacagtaaaacttcagcacaccagaggagtaaagaaatctaagaatagattcattggaaagggtataaacagtttcactttacctgcatcaccaacccccaaaagtggcacagctcagtaacaagagcccattatttcttccacagaggaaaaggagagtataataagtaagtgtccagtttctcaagacatacaggcccctgcccaagagatccactttattttcatctcacccagaatattgaggtgatcagcaaggtggagtggttgggagagggtaaaagcaggaaagagagatggggactcaaacagcagcccatacttggaactgccatagatcctaccagttacttcatggactccatcaggaacccacctataagccacaggggatgcatccctcccatcttgccaacaaaaccccgaatgctccaaatgcctcacccactctttggctggctcccaagtgcgctcctgtgaaaagcgagtgagtatctctgcagatggcttgcaagcacatgttgacagctggctccactctgtagaactggaaaaaagctcacatacatgagaatttcaggacactaccctaaaaaaaaaaatgagacttcagcacctggcctggctttatgcaacctagagaaggtgatatgatttggctctgtgtccccacgtaaatctcatgtcaaattgtaatccccacgtgttggacaagggacttggtgggaggtgattgaatcatgcgggtggacttccctcttgctgttcttgtgatagagttgttatgagatccagttatttgaaagtatgtagcatgtcccccttcactctcttgcactcctgctccaccttggtaagacttgcttgctacccctttgccttctgccatgattgtaagtttcctgaggcctcccagctatgcttcctgtatggcctgcagaactgaactgtgagccaattaaacctcttttcttcataaattatccagtcttaggtagttctttatagcagtgtgagaatggactaatgcagaaggcatacaacctttagaatttgcccccttgagggaacaagatgtgtgaagcaggttcatccatagaaaatgtctgagagaacctcaaaatccctaacctgactaactgatgaaagtgtttctctcctaaggccagtcagtaaagaccagagggggtgactgtttctttaaatgcaaaggcagcagcacaataattcaagaaacatgaaaaatcaagaaaacatgacaccaccagaagaacacaatcattttccaataaccaactccccaaaaatggagatttacaaattggtttataatgaattcagaacaattatgttaaggaagctcagcaaactaaaaggaacaccaatagactactctgtgaagtcaggcaaacaattcatgaacaaaactagaaattcaaaaaagagaaaaattatcttaaaagaaaacccagaagttatggagctaaagaatacaatgcatgaaatgaaggagcgtatcaacagcaaagttgatcaagcataagaaaaaaaaaatctgtgaaactgaagactggctatttgaaattattcatcagaggattaaaaaaaaaagaatgaaaagaaataaagaaagcctacaggatgtataaaacaccatcaagagaactaatataaggattattggagtcataaaggagaagagagaaaagggtagaaaacttatttaagaaataatggctgaaaactctccaaatctaggaaaagatatgagcatccaggtatatgaagctcaaagatccccgtacaggatacattccaaaaagacttcaccaaaacacatgataatcaaactgtcaaaagcaaaatcaagacgatgaataaaccaccaatcactaagagggagacaggattcttatgttgtcattattatttacatataatttcagtaaatgttattggaaaatttataatgttttaaaaaaagaaatttgaaagcaccgaaagaaaagagactcatcacatacagggaacccttttaaggcattcaagagatttctcagtagaaaccttacaaaataggagagagtgggatgaactatacaagtgctgcaaggaaaaaaatgccaaccaacgctttacctggcaaatctgttcctcagaaatgaaggagagagaagaactttcctagacaaacaaaagctgaggcagttcatcaccactagacctgccttacaagacatactaaggggagttcttcaagctgaaatgatatggcaatagttagtaatatgaaatgataaacctcactggtaaaggaaagtacatagtcaaatttagaacactttgatactataatgatggtgtataaataattttactgtgctatgaaggttaaaagacaaaagtattaaaaaaaacccatagctgcaatagcttgtcaatgcatactacagtataaaaagatgtaaattagaacattaaaaacatagcatgcaagggtagggaagtaaaagtgtagttttcatatgtaatcaaatttaatttgttatcagcttaaaataaattgttatacctatgttttatgtaagtgtcatggtaactataaaggaaaaacctctagtagatacacaaaagaaaaagagaaaggaatcaaaacataacactacagaaaattatcaaattacaaaggaagacagcaagggaggaacaaagtaaaaagagcaagaaaaaatttaacataatgaaaacagtaagtccttacgtgtcaataattactttaaatgtaaatggattaaattatccaaacaaaaaaacagactggacaaatggattttagaaacaacaacaacaacaaacaccgcacacacacacacacacacacaaaccacccagccccaactatgtgctgcctacaagagatttacttccactttaaggacacatacaggctgaaattaaaagaacagaaaaagatattgcatgcagatagaaaccagaagagaggagaggcatctatacttacagcatacagaaaagattttaagttaaaaactatatcaaaaggctaagaaggtcaaaatggtgaagcagttaattgttcaagaagacataaaaattgtaaatatttatacacccaatattgaagcacctaaatatataaggcaaatattaatacatataaaaggagaaatatacagcaatacagtaatagtagtgaacttcagtgcctccctttcaaaaatggataatccagacataaaatcaataaggaaacatttaacttaaacttcactttagaccaaatggatctaacagacattatactgaacatttcatccaacagtggtagaattcacattcttctcaagcacacatggaacattctccaggatagattatatgttagctcacaaaataatattacaaaatttaataaagctgaaatatcaattattttgcaccacaatagtataacactagaaatcaataacaagatggaaactggaaatttacaaatatatagcattaacatattcctgaacaaccaatgggtcaaagaaaaaaatcaaaataattttgtgacagcaaagtagaaacacaacataccaaaacatacaggacacagcaaaagcagttctatgaggtaagcttatattgataaacacatttaaaaaaagattttaaataaacaacattacacctcaaggaactacaaggaagaaaaaaaaacaagccccatgttatcaaagggaaggaactaacaaagatcagacagaaataaatgaaacatagactagaaaaacaatagagactattaataaaacttagagttagttttttaaaaaataaaatcaacaaacctttagctagactaaaaaaagagaagactcaaataaaataaaaaatgaaagaggagacattacaactgataccacagacatacaaattaagagaaaactatatgccaacatattagttaacttgcaatgggtaaatccctagaaacatacaacctacaaaaactgaatcatgaagaaatggaagatctgaacagatcaataatgaataagggaattgaatcaatattcaaaaatctcacaaaaagaaaagctcaggatcagatggcttcactggtgaagactgccaaccatttaaaaaaattaataccactctttattaagctcttccaaaaaaattgaagaggagaaaacactttcaaattcattataagaggccagttttaccttgatatcaaagatttaaaaagaacactttgagaaaggaaaattacaggccaaaacccttgataaatatagatgcaaaaatgctcagcaaaatactagcaaacctaattcagcaacacattataatggcatacatcatgaccaagtgagattcatgcctcggatgcaggatagttcaatataatcaaatcaacaaatgttacactactttaacagaatgaaggataaaaatcatatgatcatctcgatggttgaactagtttacagtcccaccaacagtgtaaaaatgttcctatttctccacatcctctgcagcacctgttgtttcctaactttttacagatcaccattctaactggtgtgagatggtatcttattgtggttttgatttgcatttctctgatggccagtgatggtgagcatttttcaagtgtctgttggctgcataaatgtcttcttttgagacgtgtctgttcatatccttcacctactttttgatggggttgtttgtttttttcttgtaaatttgtttgagttctttgtagattctggatattagccctttgtcagatgagtagattgcaaaaattttctcccattctgtaggttgtctgttcactctgatggtagtttcttttgctgtgcagaagctctttagtttaattagaccccatttgtcaattttgtcttttgttgccattgcttttggtgttttagacatgaagacagtgtggtgattcctcaaggatctagaactagaaataccatttgacccagccatcctgttactgggtatatacccagaggattataaatcacgctgctataagccataaaaaatgatgagttcatgtcctttgtagggacatggatgaagctggaaaccatcattctcagcaaactatcacaaggacaaaaaaccaaacaccgcatgttctcactcataggtgggaattgaacaatgagaacacatggacccaggaaggggaacatcacacactggggatggttgtggggtggggggaggggagagggatagcattaggagatatacctaatgctaaatgacgagttaatgggtgcagcacaccaacacggcacatgtgcacatatgtaacaaacctgcacgttgtgcacatgtaccctaaaacttaaagtataattaaaaaaaataatgctgctataaagacacgtgcacacgtatgttcattgcggcactattcacaatagcaaagacttggaaccaacccaaatgtccatcaatgatagactggattaagaaaatgtggcacatatacaccatggaatactatgcagccataaaaaagatgagttcatgtcctttgtagggacatggatgaagctggaaaccatcattctcagcaaactatcacaaggacaaaaaaccaaacactgcatgttctcactcataggtgggaattgaacaatgagaacacttggacacaggaaggggaacatcacacactggggcctgtcgtggggtcagggtagggggagggatagcattaggagatatacctaatgtaaatgacgagttaatgggtgcagcacaccaacacagcacatgtgtgcacatgtaccctagaacttaaagtataataaaaaataaatcatatcatcatctcagtagatttagaaaagcatttaacaatattcaacatcctttcagaactaaaaactctcaataaatcaggtatagaaagaatgtgcctcaacactataaaagccacatatgacaaacctggaggtaatatactcaatggtgaaaagtaaaaagctttgactctaagatcagaaccaaaacaaggatgtccattctcaccacttatatttaacatagtagttgaaattctagctagagcaattaggcaagaaaaaaggcacccaagttggaaagaatgaagttaaattgtctctgtagatgacatgatcttatatatagaaaacactaaagactccaccaaaatgctgttttaattagagcttaaaaaaataattcactaaagttgcaggatacaaaatcagtatacaaaaatcagttgcatttctaaacaccaaaaacaagttatccaaaaaattaagaaaacaatcctatttgtgatatcatcaaaaaataaaatactaaagaataccaaagaaactgaaaataaatggaaataaatggaaagatagcccatgttcatggattagatgaattaatactgttaaaatgttcatactacccaaagcaacctacagattaagtgcaattcctactaaaattccaatgacatttttcacagaaatagaaaacacactcctaaagtttgcatggaaccgcaaaagactcaaatagatgaagcaattttgagcaagaacagtaaagctggagacatcacactacctaacttcaaaattttattaatcaaaacagcatgacataaaaacagacagaaaagaccaatggaacagaatagagagcccagaaataaactcacgtttatagagtcaactaatattcaacgaaggtgccaagagtacacaatggggaaagtatagtctctacaataaacagcactgggaagacaatatccaaatgcaaaagaatgaaattacacccttatcttataccatacacacaaatcaaatcaaaattgataaagacttaaatataagacctgaaaccatacaatctttaggcaaaaactcattgacattggtcttggcaatgatttttttgatatgacaccagaagcacaggcaacaaaagcaaacctaaacaagtgggaccctaacaaactaaaaagtttctgcacagcaaaggaaacaatcaatcatcagaattaaaaggcaatttatgaaatgggagaaaatgtttgcaaaccacatatctgataaagggttaatatccaaaaatatataaggaatgcataaaattcaatagaaataaacaaacaaataatccaattttaaaatgggtgaagaacctgaatagacattttttcaaagaagacttacagataggcaacaggcatatgaaaaaatgcttgacatcactaataatcagggaaatgcaaatcaaagctccagtgaaataccacctccaactattaggatggctattatcaaaaactcaaaagaaaacaagctgggggaatgtagagaaaagggaaaagaagatccttatacactgttggtgtgaatttaaactggaatagcccttatggaaaacagcatggaggttcctcaaaaaattaaaaatagaactactatatgatccagcaatttcactattgagtatatatccaaatgaattaaaatcactgtcttgaagaggtatttgcacactcatatttatttcagcattattcacaatagccaagacatggaatcaacctaagtgttcatcagtagatgattagataaagagaacgtggtatatagacacagtggaatctatttagtgttcaaaaagaaggaaatccaacttttaaaatcctttaaaaagttaaactcataaaaacagagaggagaatggcggtttccaggaactggagggtgggagaatggggagatgttggtcaaaaggtacaaactttcagttataaaatgaataagttctagagatctagtgtacaacagcattactatagttaataataatattttttatacttgaaatttgctaagagtaaatatcaatattctcaatacacacaaaacagaactatctgaaggcactgatatgttaattatcttcattatagtaatcatttcacaatgtataatgaatatcaaaacaatagtgtacatcttaaatatatacagttttgatttgttaatcatacatcaatgaagctagaaaaaatgttgtaatttttaaaacaatagtaatataaattaggggtgaaggaattgacctatgttggagaaaagtttttgtaaactatttaaattaattggtatccattcaagctagattatttttaattgttaatttaattgtaatactaaggcaaccactaaaaaagcctttaaaaaaatatagcacttgaggctgggcatggtggccctcaattatatatataatatatataaaatatatattatatatatagtagatgaacaacaatgggatttaaatggtacactagaaaatatctgtttaacaaaaagaaagcaatagtggagaaatataagaacaaaaccatgtaagatttatagaaaatgaatagcaaattggttgacctaaaccctatcttataattatattaaagataaatgaaataaatactacatcaaaaggcagagattatcagaatagagaagaaaaatccaaaccataattcaaccttatgttatctgtatttagaatatttagagtcaagacacaaatagatagagttccatttgggcgtgaaaatatttaccatgcaaaatgtaattaaaatagagctagagcagcaatactaatatctgacaaaatatactttaacaaaaattgttgctaaagacaaaaaagaacattttataataagacacaacaattataaacatatacaccaaacaatagagcccaaaatatacaaagcaaaaactgctagaattgaagaaagatagaaaaatcaatgattacagttggaggtgtcaataccaaactttcagtaatacacagaacaacaagtcaaaagcaaaaaggaaataaaaaactacacattatcatacaacaccttaatacgatatccaacaatagcagaatacacattattctgaagtgcacatggaatattcttcaggatgacacatattaggctgtaaaacatatcttaataatttaaaagaattgaaataatacagcacatattctctgactgcaaaatattaaaccaattacagaagaaaatgtgggaaattcacaatgatatggagatttaaaaatacttcaaagtaaccaatgaatcaaagaacaaatcacaagagaaattagaaaatattttagatgaataaaactgaagaaacaacataccaaaattttgtggttgtagctaaagcagtgcttcaagggaaatgtataacagtatatccctaaattttaaaaaaatctcaatccaataacctaatttttcaccttaagaaatgagagtgaaagagcagacttaacccaaagtaaacagaaggaagaaataataaagattagcatggagataagtagtgaaaataaaaacaatagagaaaattaataaacttgaaagttggttcttctgatatatcagtaaaattgacgtattattagtttgaccgagaaagaacaaaagagagaagattcaagttactagacataaatgaaagtatagatatcaccttacagaaattaaaagaattctaacagaatattgtgaaaaagtgaatgtcaaaaaattaaattatatgagatacacaaatccctctaaaggcacaaactaccacagctggtgtaaaaacatgaatacaccatttacagttaaaaagactgaatagataaaaattttaagaagaaattgagtaagtaatttaattttcaaactataatcccaagaccagatgttttcattggtgaattctaccaaactttaaaaggattaatatctatttttcatacactctttccagaaaatagaaaaggagggaacactctataactcactgtatgaggtccgtattacccttatatcaagaccaaacatcataagaaaagaagactaaagacttatggtttctgctctgatatgtttggaagtcatcactactattgtcacaaggaaaaatctgaacaaactaaagtcaacgatttcttaaactaaccatagaattgaggtaacgggcgaaaactggagatgtaggcaaatacaaaaaaaatcacagtttatcaggagcagaaactgctgaaaccagcaactcgtatgaacatgttaagtggtaattgacaaatttctggagattgaatgtggactggattgagagttaggaactcctaagtgcccagtttttgatgaccccacacacttttgtaaactagacttccaagagccccagcaagtttcttacagtgaagactgcagaaaaatcccctgatgcttcagataggaggaagggaaaagcaactattttgaaataagcccaggggacaagtagttatttctaaacactctcagagcattttctttcacacggcagggggctccctgcaagggaagctactttgcctgagccttgtctgatgtaggagaaaaggaattggatggctcaagctccatctagcctttctgatttatataagggaagcaaaaaataggttaagaaactcttctgaaagtcacaactcagatttattttatatttatttatttatttatattttttgagacggagtctcgctctgttgcccaggctggagtgcagtggcgcgatctcggctcactgcaagctccacctcccgggttcacgccattcttctgcctcagcctcctgagtagctgggactacaggcgcccagctaattttttgtatttttagtagagacggggtttcaccacgttagccaggatggtctcgatctcctgacctcgtgatccacctgcctctgcctcccaaagtgctgggattacaggcgtgagccaccgcacctggcctcacaactcagatttaaccataagattatagaacacttctcctcccaaaacagagatatagatcaatggaacagaacagagccctcagaaataacgccgcatatctacaactatctgatctttgacaaacccgagaaaaacaagcaatggggaaaggattccctatttaataaatggtgctgggaaaactggctagccatatgtaaaaagctgaaactggatcccttccttacaccttacacaaaaattaattcaagatggattaaagacttaaacgttaggcctaaaaccataaaaaccctagaagaaaacctaggcattaccattcaggacataggcatgggcaaggacttcatgtctaaaacaccaaaagcaatggcaacaaaagacaaaattgacaaacgggatctcattaaactaaagagcttctgcacagcaaaagaaactaccatcagagtgaacaggcaacctacaaaattttcacaacctactcatctgacaaagggctaatatccagaatctacaatgaactcagacaaatttacaagaaaaaaacaaacaacctcatcaaaaagtgggcaaaggatataagcagacacttctcaaaagaagacatttatgcagccaacagacacatgaaaaaatgctcatcatcactggccgtcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattgctatatatatatatatatacccaaaggactataaatcatgctgctataaagacatatgcacaggtatgtttattgcagcactattcacaatagcaaagacttggaaccaacccaaatgtccaacaatgatagactggattaagaaaatgtggcacatatacaccatggaatactatgcagccataaaaaagatgagttcatgtcttttgtagggacatggatgaaattggaaatcatcattctcagtaaactatcgcaaggacaaaaaaccaaacactgcatgttctcactcatagatgggaattgaacaatgagaacacatggacacaggaaggggaacatcacactctggggactgttgtggggtcgggggaggggggagggatagcattaggagatatacctaatggtaaatgacgagttaatgggtgtagcacaccagcatggcacatgtatacatatgtaacaaacctgcacattgtgcacatgtaccctaaaacttaaagtataataataataaaaaaaggctacctaaaaaaaaaaaaaagaacacttctcctcccaacaccatatcaccacatcaaccaggactccagtgtaatagcagtgaattctaactgaaagaggtgaaagacactgattgtatttaagaaagatcttctaaggaaatccaaaaatagtaggggagatcaaaacaaagatactagaggaaattgaatatgtgacacctatagctacaaaaaaattaaacataacatagccctaaccatataaacataaaacctcacacaaagacctattatctgagattctgttgcctgatacattgcgttttatttcaataaaaaaattagagggtatgttaaaaagcaggaaaagttagtctaaagagacaaattgagcctcagaagtaggctcagatatggcagagatttggcaattatacctagagtttaatataaatgattaatataataagtgttctaacagaaaaaggcaacatgcaagaacggatgggtaatgtgatcagcaagaaggaaactctaagaaagaagtcaaaaggaaatgctaggaataaaaacctacaagaaataaagaatgcctgtgatgggttcctcagtagactggacaaggtcaaagaatcagtggatttgaaaatatgtcaacaaaaactgccccactgaaatacaaaagaaaaatagaattttaaaaacgtaacacaatctccaaaacagtgggacaattacaaaagatgtaatgtgcctaatgcaaatgacagtaggagtataaagggagaaaggaatagaaaatctgaagtaataatggcagagagttttccaaaattaatgctaaaccacagatacagcaagcccagagaacaacaaggaggaaatttagtaaagcgtctgcaaccaagtatgtcatattcagactgacaaaaccaaaggtgaagagaaaatattgaaagaagacaaagaggaaaataaatatcaagaaaatacatacgaaatacatcatacatacataagaaatacatcagaccatacaagcaagaagagaatggagtgaaatgtttaaaatgttgaaaaaaaaactatcaatttgcaattctgtatccagtgagattatctttcaaaagtgaagagggaaatggcagagaagtcatctccaagacctatggtttcccttcacagaaacactgaaaaatatgaacaaaagtggtcagaattaactttctaagaattctataaaatggtaaaatgtttacaccagtaaagcaaatgctgaattgagaaggcaacttaaaaaggtgaagaaaacttcgtattatttttatgtgtccttgccccacgtccttccctaccttagtcttgaagatggcagcccacatttctactgtggggctctggtttctgtttcctggttcaagagggagaataacagaccttacttttagtcattattatttccttctttctgatttccttgggtttattttgctcttctttctactttattgaaatgagaactaagattatgatttgagacatttttctaatgtaagcatttagtgctataaatttccatctcaacactgctttagtcacatcccacaaatttttatatgttgtaatttcactttcatttagttctatttttaaattttttctttttatacttcctctgactcacagattacttagaattgtgttgttcagttttcaaggatattgtagattttcctgtttctctgttgtctaatagttctgttccattttgtacagatagctcacgctgtatgatttcaattttttaaaaaattgtgctttgttttatggcccagatatggtctgtgctgtgaatattccatgttattataaagtatgcctgttatattattatatatatataatatatataattataaagcatgcccgttttgtattgttagcagagtattctagaaatgtcaatgagatcttgttggttgatggtgcttttcagttctatatctttgctaattttttttttttttgcttagtagctatatgagattctgagagaggaaattgaagtctccaaccataattgtggatttgtctatttctcctatcagttctatcagtttgtgcatcacatatttgaggctctgttgtttggtgcatacacaagtggaatcattgtgccctcttggtggcttattttatgattatatagtgcctatctttgtggtatttttatttgctcttaaatctactttgtgttatattcatatacccattcttttttaaaaaaaattgtttgcgtgatacatcttttccattcttttaatctcagcctatctgtgccattgaatttgaagtgagttttcatatagagaacatattattgaatcatcattttaaaaattccttttgccaatcttttttatactgaggtaaaattgacataaaatttatcattttaaagtgtacaatacagtggcatttggtaatacacatgttatgcaacgttaactctacctggctcctaaatgttttcatcatccccaaaaggaaacttcatactcattaagcagttaattcccattccttctctcggccactggcatccgcaaacctacttttctgtctctatgaatttacctattatggatattttgtataaattgaattatacaataagtgacctttatgtttggcttcgttcgcttcgcatactatttttcgatattcaaccatgttgtagtatgtatcagttttatttgaataactcaattctttttgttgtatagctaaaagttgattcctaggtcataatgataattctatgtttagtttattgaatagctgccaaagtttttccacagtggctctgtcattttaaaatcccactagcaatggatgagagttccaatatctccacatccttaccaatattgttattttatatttttataattataattttcctagtgaatacgcaatggtatctcattgtgtttttggtttgcctttccctaatgactaatgatgttgagcatcttacaatgtacttgttaactatttgtgttctttagagaaatgtctattcaagtgccttgtccattttaaaaatcgagttgtcttgttgacttatgagttctttaatacagtaaacgcttatcagatatgatttataagtattttaacccattctgaaggtcaccttttcacttttgtggtagaccattatgcacaaaggttttaattttgataaatccaatttatccgcttttgttgttgtttttgttgttcgtgcttttgcaaaacctagtgtcatgaggttttctcattatctttggagaattttatagtttgggtctatacatgtagattattgatctaatttccattaatttgtgtgtatgctacgaggtaggggtccaaattcaatttttgcattgaattgaaaattcatattttcagtttcaaatttcaactgcatattcagttgttgcagcacaatttgttgaagagatcattctttaccacagggaatgatctgggacccttgtcaaaaatcaattgatcatagatgtatgggattatttcagactttagatcttgttccatgaatatgcctatttttatgccagcactgcagtattttcattactgtagctttatcataaattttgaaatcaggaagtatgtatcctccaagtgtgattttcatttgctagagtgttttgactatttggggtctttgcaattccatatgaatttcagaattggcttttcatttaaaaaaatggtagttgagattttcataggaattatattgaatctacagatcactttgggtagtattgccatcttaacaatattgtattccaatccataaacacggatgtattgccattcatatctttttttcttttctttcggcaacatttagtatatgacacttgtaactccttggttaaatttatacctaagcattttatcctttctgatgctgtttaaatggaattattttattaatttctcttttagatggcttgttgcaggtgtatagaaatagaactgattattgtgcttttattgaattatctgaaactttgctgcatttattaactctagtaggttttttttttctttaaagttgtctatatatcttgctctgtgaatagataattttacttcttgatctccaatatggatgcctttctttctttttcttacctaattgctgtagctagaattttcagtataatgtatgatagaagttgttcacaactatccttgtcttctttctgatcctaggggtatagctttcagtctttcaccattaagcacaatgttagctgtggggttttcttagatgccatttaatatattaaggaagtgctctgctatttctaattggttgagtatttttattataaaatggtgttagattttatgactttatgtactgcataattgagattatcatgtggtcttttcattcgattaatgtggtatattttatgattttcatatgttgatccacctttatattcttggggcaaatcccactgtgtacacgggttttttagggtctcctaattttcttcattctttttcttttctctccctgagactgaataacgttaactgacctatcttcaagtttactattttttcttctgctgttcaaatctgcttgaacctatagagtgaatttttcattttacttattgaacttttcagctccaaaatttctctttggctactttgtataatatctatctctctatagatattctctatttggaaagacatttttctcctggttttctttacttatttgtattttttaaagtctttaagcatatttgagacagttgatttaagtatttgtgtactaagtccattgcctaagcttttgcatagagattttatattaatttcttttttttctgtgaacaggtcttttttttttttttttttttttttttttttttagaaaactggacattttgagtagtataaacgtggctattttagaaataattttcctccctccttaggttttgtttccacttgttgcatgttgctgttgtttgctcattagtgacttttctaaagtattttgaaaagtctgtgttcttgatcatgtgggtccattgaattctgtattctgttaatttcatagtcagctagtgttctgaaagttcccttaagtgcatagagccaataaaagaaaaagaaaagaaacacagaaaaagaaaagaggaaaaaaggagggaaagagatttaaaaaaataatgtcggttgggcatggtggctcatgcctgtaatcccagcacttttgggaggccgaggcaggcaaatcacttaaggttgaccatcctggccaacacggagaaaccttgtctctactgaaaatataaaattagccgggcatggtggcacatgcctgtaatcccagctactcgggaggctgagaggtaggagaatcacttgaactcgggaggtggaggttgcagtgaactgagatcacaccactgcactccagcctgggcaacaagaatgaaactccatctcaaaaaaaaataataataataatgcctttgccgatttgctctgtgtttgggccctcattcaatgcctagtcaggccatttacaactctctcttaactttcactacctgcttgtgtactgactgaaggccacctataggtgaaagcttaacatcatctcagatctttttggaccatgaatcctaccctgggtatgcacatgatcttcttaatttcccagtagatgcaagagttttagtgttttaaaagtccttattccctcatctatcttcttttctgacctttttcagtctgcttattgttcatctgaactgacatcctttgccccaagcggctgtggcaaaaacttttacctttaaatgctttcaccacaagccacttgggaagctgccccagacctgggactgctctgaccctgatgaaacaaagacaagaccttgtacagccaggcagccataagacaagtccatacccaaaccacagttctttcagaataaggtctatattggattctctggccctagtaaccagcatgagtctgggcttgccatcttcatggccacttgtcttagtttgctagggctgccataacaaaatatgagagactgagtggcttaaacaagagaaatttattttttcacaattctgaagaccagaagtccattactctgaaatctctctccttggcttgcagatactgccttcttgccgtgtcctcacacagccttttctctgtgtacacatccctggtgttttttaagcctgtccaaattttctgttcttctgaggacaccaatcagattggattagcgaccacccatatgatcattttaccttaagtacctcttcaaaggtatcagagtagtatatttgctacagttgatgaacctgcatacaacatcatcacttgaggtctgcagtttacattagagttcatcgttagtgttatatattctagggtttgttttgttttgagacagaacagagtcttgctgtgttacccaggctggagcgcagtggtacaatctcattgctacctctgcttcccagattcaagcaattctcatacctcagcctcctaagtagctggaactacaggcgcacaccaccatgcccagctaattttcgtatttttagtggagatggggtttcaccatgttggccaggcaggtcttgaactccttgcctcaagtgatctgcccgcctcagcctcccccagtgttgggataacaggcatgagtcaccatgcctggccttattctatgggttttgaaatgtataatgacatgtatccatcgttgtagtattagatagaatagcttcattaccctaaaagtcttctttgcactgggttgagttttaaaagctctttgattattttatgacagttccttattagatatatcttttgcaagtatttttatcagtctgtggttatcttgtcttttacagagcagtaatttttaattttaataaaatccaatttgtcaattacttatctcatatgactctggtgttacatctaaaatgttaccaccatactcaaggtcacctaggttttctctaggaattttatggttttgcattttacatttggtgtatgacccatttgaagttaatttttgtgaggttgtaaggtctgtgcctagattcattttttttttttttggcatgttacttcagtattcataagaaacattgttctgtaatcttctttcttatagtatcttagtcttgctttagtttttgggcaatgctggcctcactgaataaattcaaagtgttccctcctcttcaattatttggaaaagtttgagaaagactattgttaactgttttctaaatttttggtggaatttaccagtgaaccaactggtcctaggcttttctccagtaggtggttttgattatgctttcaatctctttacaagttacacatctatacagacttttataattcagtcttggtaggttgtgcgtatttaggaatctgaccacttcatctaagttatccaattagttggcatgcaattattcgtagttctctgaataatcatttttatttccacaaaattggtaatatcccagtttccattttttatttcattgaatcttcttttttcttagctaatctagctaaatgtttgccaattttgttgatcttttggaagaaccaacttttgatttattaattttctctactctttttctgttctttatattatttatttccacactaatctttactattttcttccttctgttggcctttaattttttttttttaatttttaaggtgtaaatttaggttgagaaattttttaaatgaaagcatttagagctataaattttccttctggtgttcctttcactacctgccataaattttgatatgttgagtttttgtttgtcttggagtattttctaatttgtcttctaatttcttccttgacctattggttatttaaatgtatttaatttttgcatattgtggatttcccagttttccttctgttattgatttctagttttattccattgtgatcacagaagatattttgtataatcgcagtctattaacatttattaagtcttgtggcctaacagaggatctatgttggagaatgttccaagtgcaattgagaatactattctggtgctattaggtgaagtattctctatatgtctgttaagtccaattcatctatagtgttgacgtttcctgttccttactgattttctgacttattattctatccattattaaaagtggagtggtaaagtctctattattgtagaactctctgtttttcaagtctatcaatatctgtttcatatattttggagctctgtttgctgcatatgtgtttacaattgttatatcttcttggcaaattgaccagtttcatcaacataaaatataattcttattgtcttctaacagtttatttttctttttacataaagcctattttatctgatcttagattccctcacactccaccccagcacgcttttggttacatttacataatatatcttttccatcctttcattttcaacctgtttgtgtctttagatctaaagtgaatgtcttacagacagcataagctatgtcattaaaaaaatccattctgcttatctctgccttttgactggggagtttaatccatttgcatttaaagtaatcactgatcattaaatactttcagtattttgttgttttatgtatgtcttataactcttttgctcttcatttccttcaatattgcctttgtgtttagcttatctttttgtgtcacactttgatccccttctcatttcttttttatattttctttgtggttaccaggaggacaatgtatcaacttttaaagttattacaattttatttttttaaatctctcccattcggggattttaggaaggttaaataataatgtaaatgagatacctagaacaatataagcattcaggaattattaactcaattccaatccttcctccacctccacctctttctctgtgagattatagaaaagatgacaaaaaggatgttttctgagccctttaattgttgagaatgatctttgagaaaaagaaaaaaaatgaaagcactaggaatgtacaacagcctggaagtataattaagtgtaaattaaatagataaaagttataagcagaggaaagtatagtagaactcagtatttaaaagagaatcaatgtgaaaattatataaatttatgtaaaataaaactaccagacaaatctgatatccttaggatttttctttctttcatgtgatttctaattgctacatatgacactaaaccattgatctgagctgtaagagaaactggaaattgttctgttatcttttgtaagatttctagaacattttgccctcagacttaaatgccaacgtatttctcacttattgtttactgcttttggatttacatatgatttgattctttcttatctcttatccttacaatgtaattcaaactgatgccaatttaagttcaattgcgtacaaaaactctactcctatgcagctccgccccatctaatttacattattgatgtcgcaaattccatctttgtacatagtttacatattaacatggatttatacatttttatgtatttggtttttaaatcctgtagaaaataaaaagtcaacacaccaatattaaaataatactggtttttatatttgtccatgtgcttacctttatcagtgttctttacatctttatacgggtttgagttactgtcttgtgtcctttagttccaacctaaagaactccctttagcatttttatagggcaggtctagtggtaatgaactctctgagtttttatttagggatgtcttaatttctagctcctgtttgaagtaaatttttctggatatacaattctctgttgattgatttttgttcattttcccttcagctcttttaaatacattatcccactttcttctgccttccaaggtttctattaacaaaattcagcttataatcttattaaagatctcatgtacatgagtggcttctctcttgctgttttcaagattctgtgactttggtttctgatagtttaaatataatgtgtcttattgtgggtctctttggatttatcctagagtttcttggtcttcttacgttggtatatccatgtatttcaagacatttgagtagttttcagccattatttcttcaaacaatctctcctctttggggacttccattttacctatattggttcttttgatggtgtggcaccagtcccctagactttgttcacttttttccagtcttttatttctgcttctcagactcaacagcttcaagtgttctgtattcaagtctgctgactctttcttcttccagctcaaatctgctgttggatccccccttgtaaaatttttaattccattttagtgtttttcaagttaagtatttttattaggttcctttttataatttctttttgttgatattctcattttattacacataatttgtctgatttccattagtttttttctttgttttcctttagctctttgaaaatatttaagacattttaaaagtctttatccaagttcaatttctatggttctgtagagatattttctgccagtttatgttcttcttttccatgggccatgttttcctgtttctttgtatactttctaatttttggttgaaaactgagcatttgaaaatagagccaactttcccagtttctgcagagagtctttatgccacagtattcgttcactgattaactgggtatatctaagcttagggagcagctgagtcaaaagtttaaggtcttctcaggtcttttctgagtatacatgtttcctatgcctgtgtgaaatgttctcaatttccctatataaacagctacttcttcttttttttttttttttgagatggagtctcgctctgtcacccaggctggagtgcagtcatctcagctcactgcatcctccacctcccaggttcaaacaattctcctatacaggtgtgtgccaccacgtctggccaatttttgtatttttagtagagacagggtttcgccgtgttggccaggctggtctcaatctcctgacctcaggaggattacaggcttgagccacagtgtccagcctaaacagctacttttgaatgctttaatttcctgaatagtctcaacccagtttttccttgaggtcttaggtggtccattgtatgtctccacccatagttgcttgccccaggcatctgtgggtctgtggtaccactgcagctttcaccacctgtagctgccacctttccctatctgagatccaggttaggtgagagagatcattccttcacgcagtcccatgacaggttggaacatttcaaataaggtctgttctgctcctctggttgaagggagaaaattgggaaccggtttcccaccttctacaaaccaagatctcatgttgccacgggagtggcagggcaagtgcaagtgaaaatgccatacaattttctaccattttgaacgcgggtttttcttcaatggtcatttgcttggttgctgtaggcctttcactgttttccagagctcccataagattactttagccagttttttgttctttcctgatgcttccctggcagagtaagggttggaacttccaccattttgctgattcataactctgtagtcagttttaaatatattgatacttgagtttgttttatggcccagaatatggtcttggtaaatgtttcacatatactcagaaagaatgtgtattctgatgttgttacatgggctgttctataaatgttacttaaggtggttaataatgttgctcaagtcttctatattcttgctgattttcttttatttatttattttattttttttattatacttttaagttctagggtacatgtgcacaacatgcaggtttgttatatatgtatacatgtgccatgttggtgtgctgcatccattaactcatcatttacattaggtatatctcctaatgctgtccctccctgctccccccaccccatgacaggccccagtgtgtgatgttcccctttcctgtgtccaagcgttctcattgttcaattcccacctatgagtgagaacttgcggtgtttgtttttttgtccttgtgatagtttgctgagaatgatggtttccagcttcatccatgtccctacaaaggacgtgaactcatccttttttatgactgcatagtattccatggtgtatatgtgctacattttcttaatccagtctatcattgatggacatttgggttggttccaagtctttgctattgtgaacagtgctgcaatgaacatacgtgtgcatgtgtctttatagcagcatgatttataatcctttgagtatatactcagtaatgggatgggtgggtcaaatggtatttctagttctagatcttgaggaatcaccacactgtcttccacaatggttgaactagtttacagtcccaccaacagtgtaaaagtgttcctatttcttcacatcctctccagcacctgttgtttcctgactttttaatgatcgccattctaactggtgtgagatgggatctcattgtggttttgatctgcatttttctgatggccagtgatgatgagcattttttcatgtgtctttggctgcataaatgtcttcttttgagaagtgtctgttcatatcctttgcccactttttgatggggttgttttgttcttgtatatttgtttgagttctttgtagattctggatattagccctttgtcagatgaggagattgcaaaaattttctcccattctgtaggttggctgttcactctgatggtagtttcttttgctgtgcagaagctctttagtttaatgagaccccatttgtcaattttggcttttgttgccattgcttttggtgttttagacatgaagtcctcgcccatgcctatgtcctgaatggtattgcctaggttttcttctagggttttttatggttttaggtctaacatttaagtctttaatccatcttgaattaatttttgtataaggtgtaaggaagggatccagtttcagctttttacatatggctagccagttttcccagcaccatttattaaatagggaatcctttccccatttcttgtttttgtcaggtttgtcaaagatcagatggttgtagatgtgtggtattatttctgagggctctgttctgttccattggtttatatctgttttggtaccagtaccatgctgttttggttactgtagcctcgtagtatagtttgaagtcaggtagtatgatgcctccagatttgtccttttggcttaggattgtcttggcaatacaggctcttttttggttccatatgaattttaaagtagttttttccaattctgtgaaggaagtcattggtaacttaatggggatggcattgaatctataaattaccttgggcagtatggccattttcacgatactgattcttcctatccatgagcacggaatgttcttccatttgtttgtgtcctcttctatttcgttgagcagtggtttgtatttctgcttgaagaggtccttcacgtcccttgtaagttggattcctaggtattttgttctctttgacgcaactgtgaatgggagttcactcatgatttggctctctgttagtctgttactggtgtataagaatgcttgtgatttttgcacattgattttgtatcctgagactttgctgaagttgcttatcagcttaaggagattttgggctgagacgatggggttttctaaatatacaatcatgtcatctgcaaacagggacaatttgacttcctcttttcctaattgaataccctttatttctttctcctgcctgattgccctggccagaacttccaacactatgttgaataggagcggtgagagagggcattcctgtcttgtgccagttttcaaagggaatgcttccagtttttgcccattcagtatgacattggctgtgggtttgtcataaatagctcttattattttgagatatgtcccatcaatacctaatttattgagagtttttagcatgaagggctgctgaattttgtcgaaggccttttctgcatctattgagataaacatatggtttttgtctttggttctgtttatatgatggattatgtttattgatttgtgtatgttgaaccagccttgcaacccagggatgaagcccacttgatcatggtggataagctttttgatgtgctgctggattcagtttgccagtattttactgaggatttttgcatcaatgttcatcagggaaattggtctaaaattctctttttttgttgtgtctctgccaggctttggtatcaggatgatgctggcctcataaaatgagttagggaggattctctctttttcctatttactgtacatttattccaccagtgactaaaacaggtgtatcaataaaatctgttccctcaggttttgcttcaggtattttgagggtctgttatcaggtgcataaacaagattgttatgtcctattcttaaattaatctccttataattatgaagttaattttttttttcttgagatgcagttttgctctgtcgcccaggctggagtgcagtggcacaatctcggctcagtgcaacctctgcctcctgggttcaagcatttctttgcctcagcctcccgagtagctggggttacaggtacctgccaccacgcccggctaatttttttgtatttttagtagagatggggtttcaccatcttggccaagctggtcttgaactcctgaactcttgatccacccaccttggcctcccaaggtgctgggattacaggtgtgagccactgcgcctggacctggcccgaagtaaacttctttacccttgctaatgatctttgctctgaagcatgctttgctggtattaatatagtcattccttctttctttgattcatgtttgcagggtatatctgtttccattcttttacttttaacctattgtctttatatttaaagtgcatttcttgtaagtataattggtttcttaaaatccaattatctgccttttaaatgtcatttttatatgatttgcataaatatgattattattacagctaaattgaaatctgtcatcttgctatttggtttctatttatcccatttttttcccctctttttttgctttccttgagattgaacattgtattagttttctagggttgctgtaagaaagtgacataaagtggatggcttaaaacaacagaaatttattgtttcagtttggaggctagtcatctgaaaccaaggtgtcatcagggccgtattctctctgaaacctgtagggaagaattctttcctgcctgttctagcttctagcattttccagcaattcttggcattcctttgcttgtagatgtatccctccaatctctgcctctatcataacatagccatcttctccctttatctgtctattcttctcatcttataagaacattaattactgaattggggcccagcatagattaggcctaatctcatcttgaataggttacatctgccaaagattcttcttccaaataagatcacttttacagcttttacaggtactgagagttagaacctcaatatatcctttggtggggaccgacctcttacccataaaaagtattttatatgattccattttatctcctttttaggttattaactacaatttttttttcttttttttgagatggagttttgctcttgtagcccaggctggagcgcgattttggctcactgaaacctctgcctcccgggttcaagtgattgtcctgcctcagcctcctgagtagctgggattacaggcatgtgccaccgtgcctggccaatttttgtatttttagtagaaacagggtttcaccatgttggctagggtgggtctcaaattcctgaccttaggtgatccacccacctcggcctcccaaagtgctgggattacaggcgagagccaccacgcctggctttataatttttttttaattcagtggatgttttagggtttatagtatacatctttatcacagtctagctccaagtgatatatccctttatgtatagtacatgacccttacagtagtgcatttccatttttcctctctggcatttaggctattgcacacacatacactcaattcatccctttgtgtagatccgtatttccagctgctatcttttgcttctgtctgaaatatatgtatgatttcttttatgactattttgagaaatttggttatgtgcatttgtctatttttcttatgtacttttagctcatcaatcttaagtctgtgagtttatagtttttaaaaacaaatttgaaattatttggctattatttcctcaaatatttttttctgccgcccctgctttccctttccttagggatctctgatttccacctatattactctgattgaagttgttccacgtctcttttgaaaatctctgaaaaatcttttatcatttggataatctgtatttgtacatcttcaagtacattaatattttcttttgcaatgtttaatctgctgttaatcccatgtagtggattcttcatctcaggtattgctgttttaatctctagaaattccattgaagtcttacttgatgaaaaaggcagataaaaacaaatgttggcaaagatatggagaaatcagaatctgcacacactgatgatgggaatgtaaaatggtcaaggcaatttggaaagcagtctggcagtttctcaaaaggctaaacgtagttcccatatgacagcaatcattcatctaggtatatactccagagaaataaaaacatatccacaccagaacttgaacattaattttcatagcaacattattcctaggggtttaaaattttttacattatttttatttaaaatagagacagggtctcactacgttgcataggctggtctggaactcctggaattaagcattcctcctgcctttgtcctgttttctccactggaaaagaataaaactttgtacacttggactaacaactcccgattccctcctttaccaacatgccccacagcctctagtaacttactctctactttcatgaattcaacttttttaagattccacatataagtgagatcatacaatatttgtctttctgtgcctggcttatttctcttagcataatgtcctccagattcatacatgttgtcttaaatgacaggatttaccttcctttaaaggctgactagtacttcattgtgtatatgtatcacattttctttatccacttatctgttgatgggcacttaaattgtttcaatgtcttggctactgtaagtaatgcttcaataaacatgggaatgaagatatcccttcaacatattgatttctgttcttttggataatactcagaagtgagattactggatcatatggttgttctatttttttcagaaacctccatactgtttttcatagcggctgtactaatttacattcccactaacaatgcatgagttcacttttctggacatcctccccaacacttgttatctttcatctttttcataaaagccattatataataggtgtgaagtgacatctcactgtggttttgatttgcattactctaataattagtgtgagcattttttttttttcatgtaccgaatgtcttttgagaaaggtctcttcattcctttgcccattttaaaatcaggtggttttcttgctcttgagttgtttgagttccttatgtattttagatatttacccatttccagatatatcatttatattttttcctattctttgagttccctcttcactgtgttgtttccattgctgtgcaggtcttttattttgatgccaccccatttgtctatttttgccatgcttttgcagtcatatccaaaaaaatcattcccaagaccaatgctgtggagatttccccctatgttttcttcagtaggtgtacagttttaggtcttatatgttaagttttaaatctatttttttatatggtgtaaataagggtctaatttaattcttttgcatgtggatatccagttttcccaacaccatttattgaagaccctgtccttttatacttttcagtatgcagatcttttacctccttaaatttacacctcagtatttaatatttgttgctattatgagattttcataatttccttttcagatagctcattaatagtagatggaaacactactgatttctgtaagatgattttgtattacggaactttactgagtttgtgtatcagttctaccaggttttagttttgttctggtggagacattacagttttttgtatatggttatgtcatcagtaattacagatgatttaacctattcctttcctattaggatgccttttttttctttctcttgtccaactgctctggttaggacttctagtactatgtcaaaaagtgatgagggtcgtacatggcctccatacctaatctgttgagagtttttaccatgaaaccaggttgaattttgtcaaatgctttttctgcatccattgagatgatcatatgatttgatttacaccctccattttgttatgtggtatatcacactttttgatgtgcatatgttgaaccacccttgcatcctaaggataaatcccacttcatcatggtgaatcattctttgtattcgtgaatccagtttgctaatatattgttgaggatttttgcatccatgttcatcagggatattactttgtaagtttctgtccttaaagtgtctttctctggctttaataacagtgtaacactacccttgtaaaatgaatttagaagtattccctctgcttcattgttttggaaaagtttgagaatttttattagttctttaaatgtctggtaaaattcagtagtgaagctgcctaatcctgggctttcctttggtgggatactttttattactggctcaatctcttttcttgttattggcttattcagatttgtttcttcatgattcactctttgtaggttgtatatgtctaggaatttattcatttctttaggtcatccaatttgatggtgcataacttcatagtagtttcttataatcctttgtattttggtgatatcagtagtaaatgtctcctctttcatttctgatcttatttgagtactctttttttctcctagtctaggtaagaatttgttgattttatctttcaaaaaaaaaaaaaaccaactcttagcaactcttagttttgttcatttttttccagtctttatttcaactgtgatctttgttacttacttctttatgctaactttcgggcttagtctgttcttttcctagttcctttaggtgaaaagtgagattgtgatccttcttctttattggcgtaggtttgtatcgctataaatttccattaggactgattttgctgcatcacataagttttgtttccattttcatttgtctcaaggtaattttttatttactttttgacttcttctgtgaactattagttgtttgggagcatattgtttaatttccacatattgctgtattttccaccagaattgattcttgttcttgatttctagtttcacgccattgtaatcagaaaagggatttgatatgatttctgtccacttaaacttaagattagttttgtggactaacatatatcctggagaatgttccatgggcatttgagaacaaaatgtattttgctgcttctggatggaatgtttcatatatgcctgttaagtccgtttggtctaaagtgtaattgaaatccattgtttctttattgattttctgtctaggtgatcaatctgcccatggtgaaaagtagagtattgaggtcccgtattatagtattgcagcctatctccctcttcacatcatttaaaaattgctttatgtatttaggtgggtcaatgttgggtgcatatacttttacaattgttatgtcttcttggtgaattaatccctttatcattatataacaaacttctttctttttatagtattgacttaaagtctattttgtctgatagaagtatagctacccctgctctcaatttccatttatatagaatatctttttccatcccttcactttcagtctatgtgtatgtttagtagaaaagtgaatctcttgccgggcgcagtggctcactcctgtaatcccagcactttgggaggccaaggcggcgggatcaccagaggttgggagttagagaccagcctgaccaacatggagaaaacctgtctctattaaaaatacaaaattagccaggcgtggttgtgggcccttgtaatcccagctactcgagaggctgaggcaggagaattgcttaaacccgggaggtggaggttgcggtgagctgagatcatgccattgcactccagccttgacaatagcaaaactccgtctcaaaaaaagaaaaagaaaaagaaaaaaaagtgagtctcttataggcagtatgtggttgtgacttaaaaaaaaaaaaaaatccattctgtcattctatgtctttttgttggagaatctaatccgtttacattcaaggtaactattggtaagaaactgctagtgtcattttgtaatttgttttctgattgttttgtaggtcccttgtttcttttttccctattgctaccttcctttgtggtttggtggttttctgtggtggtgtgctttgaatcctttcttttatagtatatgcgattaccattgtatttgctgtaaggctaacttaaaacattttatccttaggctactttaagcgataaaaacttgcctttagttgcatacaaaaactctacgctttcacaacccccccgcctttcgtgattttgatgtcaaagtttacacttttttaaatttgtatctcttattgtagctacagttacaattacttcttgtagctacaacttattgtagctacagttgtttttaatagtttcatcttttaaacctcctaataggaataacattgctttacctgccacctttacaatactagagaattctgactatgaattacttataccatttagttttttacttttatgtttctcattaactagcagtcttttatttaagcctaaagaactcccttttagtaattccagtagagcaggcctagtagtgacaaactcccttaggcattgtttatctggaaaagtgtttatttctccctttgccaagtaaagtattcttaattaacagctttgtttccttcagcactttgaatataccatcccactctctactggcctgtaaggcttttgctgataaagccactgaatctgtattggggctaccttgaatgtgatgtttcttatctttgctgctttcagtattctttgtctttgatttttgataacttggttgtgatgtgtcttggtgaactctttaggttgaatctgatcggtgacctcagcttcctgttcctgaattttgtcatcttttctcagatttgggaatttttcagctattacttccttaaatatgctttctaggcctttttctttcttttctccttaaggacctcctattatgcaaaagttagctagcttgatgtgtcctgtaattcttataggcattcttttttgtttttgtttctcattggataatttcaaatgtcttacctttgagctcattgattcttctgcttgatcaagtctgctgttgaagcgttctacttagattttcagttcagttactgtattctttatctttagaatttctattgtttttgtttatatttgttaaacttctcattctgttcagatgttgttttccaaatttcatttttctatccatattttcttgtactttgttgaacttaagaggattagtctaaattatttgtcatttcacaggtctccatttcttctgagtctgttactggagctttcatatccaatgtacaccagaaactttgctaattccacagtaaatgttagaaatgggtttttattgataaaatcagtggcttgctaattagtatgttagaagctggcttgcattggtgaagttgagggtattcgatatacgtatcccggctaaaatacttctaaagaacctctccagctttgcaagaatagagtataggaatctgaggaggcctttaacatggccctcagaaaggacacacagggcttgacctctaaacatataaacatatacagaaacgaggtcagaacatgttttgactgatgccagtagtaacacagcagagcctattgctggtcactgttaccaataccttgtgtaataaacctttcatttaaattgagaggttgtaagccccgaaaaagcaaagggcttacagtacctcttgcctgaacactcctgtgtgtgctttctaagaaatgcttttaaaataatgcctgtggcacaaattgatttgacactggctctctttataagctgctatcaaggttgtggggaatagctaactcttacccactttccctgacaaataggaacccgtagttacctaccaaaagtatgtaaaagctatatccgacccaaaggccagttaggtcaaaacaccttgaaaggagctcagtttaaggaaatcagtggtgtcacagtgccccactagcgtgtaaaagttttcatagtttgactatcggatgtgcttagtttcacagctgagtcttaccttgtgatacttttagagcaaaagtcaaatcaaagatgatttaaaaaaacatttcaaagattcataaagaataaatgcctcctcaggaagtcttctggagttctgcccacttcccttaggtggctctttactgtgcccatctcatagcctgtctccttccacttggtgtattgcagagtaaagctcactgtttacaggggtggtagaaagtgtggtcctttcccagactcctttttcccttcctcttctcatttttcagaagatgtgtttgataataaacgaaacaaaatgactaacacattgagctgagctacataagcagatgtcagtttgacgtgaagagtttaaaagatctatgcattatctggggactcctcccccagacctgaaggatcaggtgctgccttctatgccacctgtgcagacagcaaaagaggaaaaccatacccacgttcagtatgaacaaaggggacatttgaactctgtgtggacccctcattggaagggtgtttcttctcctgctgcatccacaaagagcactccttagccttgccttttgtcagttctctctccaataaggcttgagcagagacaacccagtgcagttcagagagactgaagtctggtgttccaggtctgagtcctagctctagctctctgtgtaactttgggatgtcccaaagtaacttttcacaacttgataggtgttaacttgaattttggatacaggtgactcttagcccatcccctctctgtgcttcagatatgtcatcacttgggccatatgacctctggacacctttcctactttccacaatttcagagcagcagagcagactggagctcctgctgcctctgagcttcagtgaattatcactcgttggagggaagcttcaagcattttgttatctttcaagagcaaacacagtgtctgtcagcaagaatatgtagcagatgctagtgaacagcagtgattagggttgaatgctggatttaaatatggagcttaggctgtgaaggaagcctgaagaacctagagccccatgaagctgccctctgtgagatctgacaccatttcccactgatgagccatgggtctaatgggtagcactgattccacatacagtatgtgagtgcaatacagtgaaagcaaagagaataaaatgatggctaacatgatgttccaaactttaaacaggagaaaaacacacaattccattatgtataagaacccacacagagatcaggagaataacctcattggagaatgaatgacctgtgtggggaatttagggtagagttgagattgaaaaaatgggccgaagtcaggtggccaagggccttaataccttgtatacaagatgtgtagtcaaggaagaccatgccttacttatgcatcaattcccttgggcctacaaagagctgcctagcctgggactgttgtagagaaaagctacagtgttccaatgacacagggactcctccatgtatgtatgagtgcccagctggctctgtaataaatcttatttttatttattaacttttcttgcgcattggcttgatgcatcagttggaagtcagaggccaaacgaagtgaacactgagccaaaggaagttctcagcctttagggaggcagaattcactttaaacacaataaacaaatgaactcacattatacaggagagagtcagaagatcccagtggctggtgtcatcgggccatatttgcccgaagtgcctattccttataggaacccactcccagggttgatgggctacatccttaggaggctttatgcctatgttctcctgaccactggctcctccagggctggccttttttagtctctctgtagaggttcctgtagctggttggatataggctttcacagaagggtcagtgccttgggtctggttacaggactgttaatcttgctttgttaagagtaatgttatttccccatttccaaattctccagggagatggaatgtcaaagatagtatgactgtagcacctaaatcctgggttccagaagcagagaagagaatacactgaagctgtagaaaggcctattagtccatgtcagagattaactggatgcgaggaccatttctgggatggtgtatacagaactggagaactggatagggagtcagaaacaaagagctgaagatgatgcctttgaagtttccaacgtggataactaggtcaacagaatattactcaagaaagtattaacataggattgagatgcagtcagtagtaatggaattgaaatttcaaagtatatacctcatggatctcagggggtgttgagctgatcacctgggctaacactcctatgaccctggggaaaatcaaatgacctggtactgtagccatggtaggggtgtcatcaccttaatccaactgggacagtgctgtttgatattcatctggaacttggtgcagacccacattttgctgggtttcaccacaaccaaggcttttttgattcttttctcttttaacatcagtacatcactgcaaagttaatcctcatataataggagatgaaactaattgcttataaaaacaagatttttacaacactaaaattgttcaagcatatgggcatatttatagttgcaggcagtgtttcagatgcagactgttcttggctgcagtggttgtttacaggcagcatctgttctgattaaatatttgatgattatccccgaatgttttaaagcatagtactgggctctgctgactgtacaacaaactggcatttttgacctatagggcactgggctaggagatacagttctgagggaagtgaaagatagttaacaactgcacaactgaccctttattagttgcaataaagcaatccaaccacccaacccactgtgatggctttcctactatttaaggttggtggtgtcaaagagacaccctcctgtacagtgtgcagtgaatcaacatcatttccacaaaacctccttcctgcacaaaggaattatcatactttgttacgaagtaaaattttcctgtatcagtcacaggagttcaccagttaagatactgttagttgaagacttctggggtgacttaatgaaatagctcagccatctggtttaaaaactggattcttctatccctccacacagctgtccatgcacctgcatcatctcaaggctggtctccctggtggtagaaaggctgacagtaaaaactggagccacatgattccttgcttaggcagtgtttcttcatactctcacatgagagcaggcatgttctttccctaggctcacagtaaacactctgtcaaatctcacaggcccaaagtgcttttggttatccccattccaagccaatctgtggcatggaagatagcattaccctgactgccttagactaatatacctactccacttctggggctgggaataattttgaggtcaaccatccaaactgcatgacagccattccatggaagaggtatggcctaaatctttggggcaacctgaattcatgaaaactctcttagatttatgtaactatttttagaattcacttctgtatcatttaattttactaataaaaataccacctttaccctaaatgtcagccaagcgtaaggctccgttgggacagaaggaactatcaaagctttgtgtttttatacattagcagcatttgacaaagaaataactctgaaggaaggagaataaccaggcagagtctagatgcatggaaaagaagtctttgagaaggcttcgcaggctgaaggaaagggcaggactacttcaggaatacaacgtttaagtaaaagaggttggggtctgttgatcttgaggagagatgaggatggactggaaaataggagtgagatatagtaggagaggaaaggatatggatgatgtatatactgtatgggtaaccatcagtcgaccctaagaagataatagttgttaaatggttagctatttaatgaaagaaacctgaacaagtaataatcttgagttgcaaagtggctggagtcacacaacagactaaatttctggtagaacaaatccagcagcttatgtgaaggttaccatgtctgaagctggatagaaaaggtctaacttccaaccaaagtcacagttcttgagctcggtacacagagacagactgctaacagctgatgtgtcctcagcgagagtgtcctcatttatatcctcgttctcttctgcctcctttttttgttttaaacttttgggaagtctcatcattcaatacagttctaatatatcacaataacagaggcggcccaatttctacaaattgactaattctatccctgaaaagttcatacaataaaactatacaaagcatcattttcaaccatcctatagaaaaatttccctattaaattttaactctaaatcctctatctctgttaataaccttactaaaaacttccccatcactgcctgccagggagatcaaaagaaaccaaatttaagaaacctccaacacctgtacctgactgaaaagcaaacatacagacctttcagtcctgcccctactattcagctcctatcacagagacatggtggatgtccccttgggaagcggatagctcttaggtggaagctaggcctgcaataagcaggccaggaaacatgtctcccaggccccatactcttggcagaagcacttggccaccagacagcatgtcctgtcaacctacagagttcttaaaaacaaacactgggacccagaatagtaccctgtggtcatagtgcccacagttcactaagcaccctcacaggtctttgacagaacactgactgccaggtcacctggtgggcagagaaatggaagattcccaggcccaactagcatctcagggaagaaccacaagcagagcaactttcagagctggtcggccagcgttggcacccagggaagcaagtgctattccatatttggagagaacataaaactcaaggaaacagagaagtcctactcaataccgttctcaactgaaaacaagagaacttgcaaaaaagaaacccagttttctggagtccatggagaaatatgaagccaatgctcggctaacagagcagaaagccttttataaataatgccagtcaaagctccaaaggtcagagctgatgcatgccggattgttctgacaatttcttaggtttctaggcaacaaggagctggtcaaacagctcacctccaaggacatactttataataccaccctggtagacgagagcgaggcagcagtgaaggcaatagtcaagaacaggagagggaggtaaagaacaagatgctcttcagacagtctggacaaagacagtccctacccagctctcaggagttgcctccttaagaaggtggaggcccaggcagctcccagggtgaccctaaagacagactccaaggaaaagggtgtgagggcaatggtgaatataaggaggtcccctttcagtaggcagagcaagtcagttcaggtcttatttttagagtctctgaacagtgaagagaagctttctgtggacagcattccaccaccatgggaggggaaaggtgccatgagagacttctccagtggggcatacaagcattgtgcagtgatccccaagatccagccactggcaggaaatcgaaaggcaagcttcttaaatacatagtatatggagacagaagtgtggagcactcccaaaatgaaaggccaagacccaggaacaacctccacaacctggagtatatacaaatgaacccagccctgctgactcagatccacaccatcctaaagcaggggtttctcatgaatgaaagggctaagtatttggtggagagaatgagaagtctcccactgcccacacattttttcttcagagatttcttttccaagagccccttgaataaaggaagggagggagcactgaatgccccagaaatcagaatgcatggtgcgggaagacgacaggaaatagttctcaaagagatcagaaaataaattggaagcaatttcattaccacaaagaacagacattttttctaaggcacccctcccctttccacccaattgtcattcagcaactactgaatacttaccaatgaaaaacgttacccctgacctcaaggctgctcctgagctctggtagaaaatgctttccttgtctataaaacatggcaagcaaggcaggatttaacagtaagggcacagtagcactgcaagccttcaaatggaaacctggagacaagcagtgagaacaggaagcaaaagcagggcaggtgaagctaggaccagggcatctggaactttccacacaggttggatctccatgccagacaacagttttcaaggaaaaatatctaagaggaacatgactttgggaaactttttggcagtactgcttactgtatactagagagtaaaagaatttggggaacattcaccaatttgcttcttcaggggcttgggtagggaacgtgaacaggaacctggctctaatttctgaacttttttatcagtaaaaacaatccaacaaacgaaagctagtcagtgagagaactgggagggtctgccctccttccctgagtcaagccttctggggggacctcctgacatttaattaagcaaagacaacgcccactgaaggaagctgacctgaaagtgacacgctactgtgaaatgagcatgaagtgggagcttgttacatatatgaaatggccagcgatcctgagcaaagcgcttcagagcttgagacctaagtcttctcatctatatactgagggctggacaagatgatctgtcaagccatttttatccctaatccaccaaaatccaatgctttagtttattgtcacaaaagcaggtatcgaatggctatcctgcagtgcctccaatcaacattcagactttttccctgaggcaatataagataacagttaacatgtttttatcaattaggtggtcatgagataaatatatatgggaagtggtagtttttcacttaaatgcatataataatggtacagctctctttgaatagtatttgtttatttcttaaatatttaagttcctaaagacggtaagaataacccaaggaagtgaaatcaatgtcacaaagcacatggctaaataactgcaggtttgcagtgccatgtgtgagatcagatgacagaagggagaactacctttaggcagaggcttctcatgtcccctggagtggccatgtgctgttctacatgactacttccacttcggttatgtagaagctatttaaagcacacagatgtttgtgatgagaaaaaagccacccttaattgaataatggaaattataagcatgatttgagggtgggggtggaggtgggagtagagatgggtagaaaggagtgcaatggaaacaaaggagccttcataaaattcaagtcacttcttaggataacgtgattgatttactcaccaccttcttaggaacataaagcaaacaagtgggttttccttttactgcttttctgaaatgagctacactcaagaaagcagcacgggggttgtgctgtccctgcacagtggcaggagagtatgaggagcaggtgaatgccacaacagctccatccaagatcatttttcacatgcaggaaccattcttatactaccctttactggtaatttctgtagaaatctggaagtctggttgacaccctcctgtacagtgtgcagtgaatcaacatcatttcccttggactttgcaatcacggtggcattcatacattcattcaacaagtatgtatgtacaggacagtggagtaaagaaaacagatagttcttactctcacgaggcttaaaatttcaggagggaactaggcagtcatgaagtaaacataaaaacacagattgtaataggcactagagaataatgaagactttggggaacacaatttaaattggaaaaatatctcagttccgttaacacatgttgaaggggaatagcattgttttgctggatttggggcctggatgcaagcatgttgggtatgcattgtagggtaatgcatttccttccatttgggcccaagtgtatatttaccacccagttgtgatgagctgggatcctcctgctcaatctcagcttgaagcacttggaggttatctgcctgctgtgggtgattattttggagcaaggtacttcatttgcctcaagaaacagatttgataccactactgtgcccttttggaacagagaagtaggcaagaccccagtgtgaggcagagtgatgggatctttagggacataattgatgatgtaactgatgatgattttggagtttatacatttccaaagtttcaaaatattttcacttggttgatttatctttatggtgatgacactacgtagatatatgcccttcttaaaagttacagtaagaggctgggagcggtggctcacgcctataatcccagcactttggaaggccgaggtgggcagatcatgaggtcaggagattgagaccattctggctaacacggtgaaactccgtctctactaaaaatacaaaaaaattagccgggcgtggtggcgggcgcctgtagtcccagctactcaggaagctgaggcaggagaatggcgtgaacccgggaggcggagcttgcagtgagctgagattccgccactgcactccagccagggcaatgagcgagactccgtctcaaaaaaaaaaaaaaaaaaaaaaaaaaagttacagtgagagttgacattgagaaaagggaggcccagccagggttatgcaaagacacagtagggaggaggatgggaagtttctgagacaccccagtaactgcatgggtccacaaagcacatgtacagtctgctctatgcactgcaggtacagccacgaataagacaaagtctctgccctcatggagcttggtgtctgtctactggagcagacaaaaacaaacctgctttttctcatttgcctctactgtgggttccgtgtataactctcaaatgctagcatttccatgcattccatccttgtccttctctcctctctgccttttccaggagaattttcctagccacaggttcagctatggtctatgtgctggagtcatacatttttatcttctgtgtacgtttttctctagacccatatttttaattgccttaggacagctctccctggatatccctcagacacaactaaaacatcattcaattgtactattaataattttcccttcaaaatccactcctcttctctatagacctaacagcaacactgtccgtccagctctcaaaacctgaaatgtgggagttgtctttgactcttatctttcccatgcatgagcactgaatcaatcagagtccctagcatgtcttggactgtggcctcccttctatcttcagattatctgcctttttagaattatggcaataacttaactgcaaagaccacatgtgcacttgtgctctttcagtttgtaataaatataaaatgaaaagtgattatgtctttgcttaacgtctgcaaaataaaagtccaaagtccttggtatggtctataaggccctcattatctgacctgcctgccttcccaatctcatcttaatcccttacagcctgacactcagacatactagactttccacctaactcactcacatacacctatcctgtatgtcaagattcggcttgaccttcatcacctacctatctgcagtatttttggatctgaattctctgcccacattgtactttcacatacttcttttacccttagtggtttgtacttatgcctggtctaactagattgtctccctgtaacagacttcttgattcaacaaagcagctctgaatcagcctgaaacctatggcacactgcaaaatggcaaacattcaataggtatttgcccagtaaatgttaatgaaaggaaaaaaattcaaacttcagttggaataggattagagacaagttaaaaaaaagtttcccatagaaatcttcctcatcgtaaatatcatcatcctaaatgtcccgagtctttccatgggtctaatttaccaaatcatgaagactctctttctcactgtgtatgtgtagtgggagaggcagagacagaacggtttttttttttttttgcaagtctgctctctggattcgtttttctggggatgaaatctcaggctatgtagcttttctggtccctttttggtaatcaacaaatcatcagtttctctaggtattaaaaagcctacacttttgaaacaccaagaggccaaactctctcttaattgaaaacataattctgcctcttactgaggtctttgggtgggaagcttaaagacagcagtgttggggcaattggtttttcttttcctccctccaccttctttcccattcaagagctgttgctgccctttctggaggggagggaattagaaaaaaagatcctgccttacccagtcactgttaattattactttgagccagggtggggaatgactttctttcctggaatacaccctgctggaaaccacagctgagattctctaagctggcagcttccaacctctcctccctcaacagcttcaacattatatggcactcagctgcagggtgcctggctccaggccggcagtccatttgtgcagggtagttttcaagatggctcatagcccatctctttcagtgaccagcgtggcctatgggaaacatacatcttgactccattattggtaggagtactctttagttaactgccacaggccagttcagacacgtcttaccctgagagccttttcagagtcaggtaccatccctgtgtcccccagcatctgaagatcacaggtgaaggtctccaagtagttcacttaaaaaatacctcagtaggtttaagaacagggaaagctcccaattcattctgtcaggagtatgactctcatccccaaactggacagatatataatatgaaaactacagaccaatattccttatgaatatagatgcaaacattctaaacaaaatactagcaaaccaaatccagcagcatagaacaaggtttatgtagcatggacaactgagattatcccaggaatgcaaagttaattcaatatacaaaagtccattaatacaacatattaataaaggacaaaacaacatgaaaatcttgatacagaagaagcatttaacaaaacccacagcccctcctttttttttttttgattaaaaaacactcagtaaactaggtttaataaaagaatttcctcaacttgaagcaaacccacagctagctaacatcatactcaatggtgaaagactgaatgctttccccttaaaatcaggaacaagaaaaagatgtctgctcttgtcacttctatccaatattgtactggaggtgctagccagcacactaaggcaagaaaatgaaataataggaatctagactggaaaggaagaagtaaaagtatttctgttcacagatgcatgatctcatatgcaaaaaatactaagtgacaaaaaaagaattttagaaaagctacaatatacaaaatcaatatacaaaaattaattttatttctaacaccagtgatgaatacaaaaataaaaattagaaaataatcatataattaaagtggcatcagtaaaatacttagaaaaaaattaaagacgtcaagacttgcacactgaaatctctaaaacatcactgaaataaagacctaagcaaatgcaaagacatcccacagtcatggaacagaaaacctaacaccattaaaatagcagttatttctcaaatttatctaccaattcaactaaatccctatcaagatcccagctgttttgcaggaattgacacaatgatcatataaaaattcatatgcaatgcaagggacccaaaacagacaaaatgattttggggaaaaaaaaaaaaaaaatggaggacttgcacatcccaaatctaaacttactaccaagctacagccatcaagacagtgcggtgctggtataacgacagacatatagggcaatggagtaagactgagaatccagaaagtcttatatttatggtcaactgttctttgacaagggtaccaggaccattcatggggaaataatagtcttttcaacaactggtgcttgggcagatggatatacagataccaatgcacttatgcaaaaaatggatgaaataggaaacttcactacattctactgcatgctcggtcattttcaatcatttaggtggcaacactgacaagataacagaaagatggaggtaataacatgtgaaaggcaaaatggtttgtttttttttttaaaaatgacagtctctatcatgaatttacttacactccaggcaaaggttattagaagaaaaaaagatgtaagaaaattccttaactgaaatgtggaaagagtatcaagaggagaccctaagacactctgtaagaatcccagtgactcctcactgttcaactaagaaatgtaccccattatgctgtgctaccacggaagcattggaggcactttgggggttgatgaagtcttcatggatgaggtactttaaatatctggtcatgaagagtatttgagaaatatgacaagtgaagatgctgggtaggaatgcagcgaggaaagtgtgtaacacaaggccaaattggaaaggtcagtgagggggcaatctgtggaggcactgaatgcagaggatattaaaattagcaagatagtgttctagcacaatgaaaaggattggaagagggagatgagagtcagggagtgaaattaggcagctgctaagaatgtccgggtgagtcagaggatcaggacctgtaagggcagtataaagaaggaaggaatgatgggagaggtttagggggaaagaagtgacaacctgtgacaattgaggaatgagagattttgatgattggggtgaaggttacatttcttaaaaagaaacaaagaatggtcggtcgatagagatgcaagatgaagaattttgtttttaggactactgactatgaggtaacaaagaaatcccagagacagaggtctgagcaaaagatatgggattggggaagaatctttgggagtgactgaggttgactagagggaactgggcaagaacaggtaaggactttaagcagaattggaggagtatccatctaaaatctgggtaaactgggatggaaaaacaagtagccagagaagcaacagcccaagctagggtgttgtcaaggttatagatgttactgattttggcaatgaggagattataaggatccttgaagactgtactttcggtgaaactaccatgcattagtagcctttcacagtgatatctaccccacacctgcatcaaaatcttgcagtgcctattaataaatgccaacccactaacggggaggggagaaaagacttgggactctgtacttgtaaaaccctctaccctccccaggcaattctttacacactaacactgttgaggtaaaaggagacaagtgagggagcaaatggaaggtgtgtttttggattatacagtggctcatggaagggtgggaggggtacagatggcccttagacactggcggaaagtcagagaaaaaaaattacagtaagcaggtaaagggatcaagactacacagggactagtcttgggacgacatttcttcctctgacagtttgtatggaattcttgagaaaaattcctcgaaggggcctgaaatctcagaatggtcatgtttttaatgggaatagggagtgatgctgccccattacaaccatctgttctaacagaatgtctgtaccgaggagggatgagtaacatcggcaagttctgttcgaagcctttttcaagtttctttttgatatgtatctatctatctatcatctccctatacaagcaagcatccccaaaagtagttgtctcaggaaaccagggttaggatgaccagctcatttgctggagctgccaaggtccagaaaagtttggctgcaggctgttttcatgttttatgtatgtttgaaatgttctataataataaaaggttaaaaaagtttacatttatttggaaaaccagttactttagtttatggttcctttttttccctccagagcttcctggagattgaggtctaattcaaagaaaaccaaaatatataatagagtacctgggcaaaaaaagtacttttataacataacatttggggtagaggaagtatccactgtagtcaaaatgtctatgttttgctcttccttattgttcagggacattccattaaatagtaatgaaaaggcagcaaaagtaagaggagtgacaacatgcccggcataattaagcaagctagagcagctattctgtgcaaccgacgattttttttctctaaaattttaagggtaggttcattctgactctgttaaaagtctacttgatgtgaacaactctatatctgataacctatttcaattaccactttaaaacttgtcatatggatacgttattacaattgtagaactttaataaataccataataataaaacttgagaactgaagagcacacatttcttcacgaatttattatataaaacgccctcagagtatttaatttctcctcactttaattacacattaagaagcacagtggatgagaagcctttaagatgactacagttgcacgaaggtccctttcatcaaggtagcgtatgtaccctaacagtgttctaaaggctggcccagaaaaaccccatgttaccttatcacaatatggaaagcattgtcttctttttccactaaattaaattatggtgaaaagtgccacagttttatttagcattatggtacataacaaacagttctgtctcaattatgaaaaaaattaattaaaataatcctgaaagacatcctttttctccccccaatgatttgaaagctgcatttttcctgccaatttcaaacaaacaaatcatcaggttgatctacagtaatcagttaaaacaatcagtcaatcaatcaatcaatcaccaaggcacaagctcagcacattagctatagcttgtagcaaaaggatatatcaatgtctcaccttagttaaaaatacataatccttttattttataatgcaataaaagaaattaacaacatcacatacacagaagactaggaaaggggaaactacttacttctggaaatcagtaatgtaaacctacttgtacttttccatagtacatgaaagtaacgtttaacatgttttgaattaattaattaaatttaatctgtggggctatacaatgtaattcttaggagtaatagtttcattcatttccaggtcagcttactgtatgattaagtaacacaaggcacagtagccatctttttcattatgttgcaacactgatcacgtgcctcgataaaatggctgattcaacaagatgatggcaacacgaaggggagactttggattgtctatttaaaatctaggtaataagtaagtaattaataaaaactctatcttaagtgcactttcacatgctttttgtttataataaacaaacaacaaacttcctaactttgttgcaataggcttgactaccatttcatttggccaaatgcactttccccagtaaacttaaaacaacaacgagaacaacaagaacaaaaatccctgtcctttcatatactaagaaagaggattggctactgaaacagttcattgcaagacacatgaagacgacatactgtggcatgagttgtttttgtttttaatttgttgtgctgttactaaagttctgagggctgcagttaaaacattccaatttctcccttccttccatctttctttattgattgattctcaagattttgcacagaaaactctttgggggctagaacagcagtaattgcatcacactgttttcaagacttcaagtttcaaaagcaaatcattaaaaaaaatacagttcctgatttgagttagatacagggacaaaaaagtagcacatacttgaaggttacgtggtctacaaatggtggcaatattttccttgggagagtagttctgttggtatatattttttaaatactcaaaaggctcaacctcaagcagtaataaacacaagcaaaagtgatttaacccttaaaataaatattcagaaaaacctctctgtacatacaagtgaaagaatatgtaacactttcacgcaaaaaaataattataataataataaaggatttgttcatatatgtagctgaaatctgctgttccagcccacatgtccccaataaagaagggaggcacagacataggtgactactgtggttgactatcttacagcctttttgtactgggacactatcaccaccaaaaatttatccctcgttatatttttaaaattttttaaattttttctttttttttccttccttttttttgttttattttgttttgttttgttttacagcatgccaaatcctttggcatacgtgatggccttcaacaatctctctttaagtttttctttgcttgagtattccggaagtaaaagcacattaaagcaagtatgagatgtaggtaacctaaatagagaaaaggggaaaaaaacaggaaaactgtaagtcatgggaaatacacttagaattaaatgctcctatttttagattgtatatagttgagacggtctgcaatgcaaactatacattaatgcaaatcataaactttttgttgtgtaactaccaagttgcctttatcctataaattactcaaagctagtgacgatgataagatactgtatccattgagtttttactacataacagataccattttaggtactgaattcttacagttcatttaactaaatctttccacaacaaaaccacagagaggacatcagtaaatgcactttagaggttaggtcactgagaagtcaagtaacttcctctaaggtggagaaaatactcaaacctgttttacaagactgcaaagtgtgtgctcttaaatgcttattagaaacactgctggcaatatgactaagaaaatgatttgataacaggattctagcacaatcaaatgataatcttccgagcctcaatgtaaccattctaaatagatgatcatgttatatggctttcaattaacaagctgggaatcaaaaaagtaaatgaatcacactaatttgattccaaaccaatgtgagccccataataatttttaactagggcaatttcttaaaagtttcctcacacaatgacagcaaagtattttctcaattgtctaatatgatttggggatttgtatataaaatcacgaatgtgctcagaaactataaagacagttcatatgtatgtgacgaggaatgcaaggttttcggtaggtatacagtcacaagttaataattacctacctttctgtgtctgggccatttttggctataatcatctttaattttcctagtcctcccacaggtgctctgtctgtgcccgttgtaaactgcaagaagagtcttttctgttcatctgtaaatgaatgaacgatttcccagaactccctaatgagaaaaaatacaatactggtttcagtttggcattcattatgactggtactaacataagcttatgatttgcattaaaactatattaagagacaacttggaagttaattatcaggatagtatcacttctggtgatttaaaaatttccaagcaaatttatcctgaacagctctgaatacgtaaaaatttagattagattacaatatagtaaaatattagtactacaatagtaaaaaattgagaaaacccaagtgtgtagtaacaggaagtgactatttaaactatggtataatcacattatgcagtcagtaatgagcaaaagacaaaatcctatgaattgaaaaagactgaaatgaatatttggaaaaattaactccaggtgcctttgggtatatattttatttatcctttctcctttattctcctggtctactcatcctttaactcaactttgggaggaaaaagtgatacagattaaggacaaaagaaaaaaagaccccctgccccaaccaactggccccaaatgcaaacaactacatacctaatagcagtaatacaaaagttcaatttttatatgaactagaatactttaaacaagtaatatgtgctgtgtatggaggaggagaattattctgacatttctgccacctgcagttattttaagagaatgatttatcctgtggcattcctaaaatctatgtaataaaagctatgttttaatgacacttatgttagtttgagttctaaaaaacgaaatacaagctcataaagtgcaatcttgaagtttatttgaataatcaggcatctataaaacatatatacactagttcatagctaaataaatttttttttttttgagacagagtcttgctctgtcgctcaggctggagtgcagtggcgcgatctcggctcattgcaagctccgcctcctgggttcgcgccattgtcctgcctcagcctcccaagtggctgggactataggtgcctgccaccacgcctggctaattttctgtacgtttaagtagaggcaggatttcaccatgttagccaggatgggtctcgatctcctgacctcgtgatccgcccaccttggcctcccaaagtgctgggattgcaggcatgagccaccgcgcctggcctatagctaaataatgttaagattaaaaaattaaaaaaaaaattaaaagtatttttagttgcttatataatataaaatgcattttaatagttatttagaaagttctttccagagccaggtgtggtggctcatgcctgtaatcccagcactttgggaggctgaggccagtggatcacctgaggtcaggggttcaagatcagcctgaccaacgtggtgaaaccctgtctctactaaaatacaaaaattagccgggcgtggtggcagatgcctgtaatctcagctacttgggaggccaaggcagaagaattgcttgaacatgggaggcggaggctgcaatgagctgagatcacaccattgcactctagcctgggaaacattttgagccatctcaaaaaaaaaaaaaaatttcatctcaaaaaaaaaaaaaaaaaaaattccagaatgttagcagagaacatcacacatcccaaaccagtaattacaattttctaccttttgatattctaatatcccaacatactatttttattaccaaaatgctggcatttttggtgctgcaacaccatttatctgaaataacttaaaagttttattagaattcttggctttctccaatctcttgccacttcccttccctgcccctttacaaatccaccagtcagcaagagaaaacaaaaaagaaacacacaacaacagaaaactggacatgaaacttgcaggagcatctctcaggtaaggaggagaggaatcggaccccagttcatgatactccttttggggaggctgacaagagaaaacaagtctgctgtagcacagaaccctccaacatagcagaaaagctgccctgcagtgggtggtaataaagcctcctcacactgcaggagggctctgaagcttaactgaaccagctacacctaaggaggtagaccaaagagcaccaccgaagaacagagacagaccctgcaggaagtggcagatcagcagtggtcacaatgaccagtctggctatattattacggagctgtttctttggacttttaaacgaaacctttaaaaattttatacaatgaaaacagggaacaaaatgcatctctattcctataagtgttatgtgtgttacattaacattttgaattaaacaagaatgcatatatttagaaagctgaagaaaacacgaagaagcttccaggtttccacataaaagtggtggctgtatcgatcacatcctactcacatctctaaaaatctacccggatcaaaaaggggaaaataaaaaaaaaacctatgacttaggtctagagtaaaactaggagacagaacaataaactccaaataccaaagaagtggggaaatgagcagggtccagcaggagctacatcgaagagtggcttgtgcggaatcatactgattagggatcacccaaggccagaccccaccccctccaccacctgcccctcaacagagcactactgagtgtaggttagagcactggcaacagggtggttaaaggaaggactacagaaaagtacttgggtccagcaatggcaggctcaggaaggcaccatgcatgaaaggaaggggggtaccttcaaaagcagaagtgtcccttaagcggctgtaaaggggtggaagcagctaatgaaaaagagtcttcattaagctacatggagctgaaaaatcagaaagtggtgattctgcccttactaaagcaacagaagagggatcccttcaaccaagacccctaaagccacacaattcctccctgctccaccatgaggtctagtaataacaggtccagaaaaaagtaacatctgttatagaaacataaacaagaaaaacagaattcggaagtctaaataaagttattatgggaagagtctggcgaatgagaagcaaaactttccggtagacaaaagtagaccagaaaaattcagtcataaacaatgggaaactagtaacaccacattccaacacaaaaggagaatgcagcagcagacaagacagaccaccagtgatgagaaatacaaattcagaaagaaatgagcacatcttaaataaaaataagaatactaaaaaatactgaagaaatatgcaaggtaactttggaaataaaggctaattttattataaggtgaccaaagaagaagcagtatgactaaaatttctactgaggacagactctagaaaattaaaaaacaaagaaaatgaataaaataaacataactaaagaaatgcatatcaaagcataataacgaaaaagattaatagctaactacataaacataaaacctttcatttggcaaaaaaatcctataagcaaggttaaaagacaaatgacaaactgggaaaaaatatttgcgaatttaccagcgttaaaggactaatctccttaacatataaagtttctaaaagtgaagaaaacgaccagctgagcagcaaaatgagcaaaagactatataaaactataaacagctctacaagaaaaaatgtccattatcattcataattgaggtaagctcaaaaattgtaactatagtaaaataccatttctcaattggcaaataagtaaacatccacatttaacaacacattctgtttggaaagttttaagaaaagagatactgttgtaaactgctggtgggaatgcaaaatgttatttttctgtgaaggaggatttggcagtatctagcaaaattacacatgcatctaccatttgatgcaacaatcccacttctaacaatttatcttaatgatactttacatatgtacggaataatgcatgaacattaagaggattcactgtgacattagtactaacagcaaaaggttaaaaataacctcgatgcccataaatattgataagctatgctgcatccacacaaaggagcagtattcagtcatacaaaacaaaatggaaaacacctctgcaataatgtgggatgattctcaggatacactaggaagattattttcctagttctgtcctctgataaggcctacaagcagtaacgttcaaaagcaaaggccatactttgcatctaaaatctgacttctaaatgccattctccaacaatttattggaaaaataacttattccaggcctgagaatgaatgttcgagattagttagaaatctcaaaatctaatagggtcattttaaaagcacacgatagctaagcaatttgaatatcatttagagtaatgactgtgaaacgtattaaatacaaaaacattcattagttcgtaatattcaaaaaggcagcaaaaaccaaccaaaaaacaaaattaaattgtcactattaaaattattacattaactccttactctaaaaaccttaaatctattttatcatgccttttctgtagaactgtttttcaaggtaatcaaatggcacccaatgatgagaaaaaagaatgccaggtatatatgtaggacaagcagatggaaattttttttccccaaacagccattttgcaatccccaatgagataacagattaaggtaatgatactgataaatacgaaaatcaggtgaagggcaggtagcaggttctggaaagatgatgatggcaacgacatagttattattattattattttttgttttattccctcccaacctcccctacaaaaacagcaaactgaatgagaaaaccaaagacccagagacattatctacaacaaaaccatgaaccattgcatataattggacagaaacaaagctctgacaactacaagactggttagtaaggaagcagatgcaaggtaactgactgggtttctgacagccctgagaacactgccaacccactggaaagcacaggccaatctgaaaacagggcttaaagttttaaaaagttctacaggatctaatttgcagatgattacaaagggatcatgatgtagtaagctctgggcccttaaaacacccgaataccaaacccccaccagaaacaaaccttgtaccgaggaaaaacttctgggaataacttccgaatggaccaggtcagtaataaaaaccaaaaaaaagttcaaatatatgtgtgggatagaggagtaaagaaggcagtttcagaaagcacaagggcatatttttgaccattttacaaaaacacagacttctcctcgtccctaaaaagcgaaaaaagttatcctggcccatctctccctcgtccaagtatgagaaactcatttcactcacacacacacacacacacacacaaataaataaataacagaacagagtgaaacagtgtaattattagagaaaaagtatgtgcatatacatgagaatggtgtccctacagaaaatcaaagtacatgaaacaatatgcaaataaaacatgaaaactgtaaacaaatttcaaactgagctaaaaagaatttaaaaaataacaaatcattagaaatgggaaatttctgaatgagggtaactgaaaaaaaggaagacatgacacaactaaggagtaattagaaatgcaaggaaaaaaatcccatcaaatacaaagaaactaaaactaaactagaagaaacataaaggtgaataaaacagaacaataataccagaacctgaaggcagaagaaaaatcttaaaatcaaaaagaaacaaacccatgcttgagactctccttgctggtccagagccacagtgctgctgtgtactggcaggaggaattctgctataattggtcctggcagtgttcacctttcctgcaagtgttccacagcccagggacacaatgtggtcaggagcactgccaggaacaccagcaagggggagcctgccacaacaggcacaaggctcaggaagcactctccagcccacgaaaatctagtgggggtcctcttccctcacccaaacacactctgcgcagctcagcctggagaaggcccctcaagcagcactactaggaaccagtgcgagccccagtggactgagataaaagcaacaaaccaaaacagcaccataaagcctctgaaaaatggtcactggaaccacagctcacaaatatatgctagtacctacatgctataccttaacaggttactactgaagttaaaatttttaaaaagtacagagtctcctgatataataactaaaatgtccgagacacaatccaaaaattatctgtcataccaagaaccaggaaaattacatgaaggaaagaaaacgccaacactgggatgagtaagatgctgaaattatctggcaaggatcttaatgctgccatcagagaaatgatttgacaagcaattacaagttctactgtttcaaaaacgaaacaatagaaaatctcagcaaggaaacaagatacaaggaaaaaaaagcaaatggaaattatagacctaaaaaatacaataggagaaaaataatcattagatgggctcaacagtagagtgaagatgacaaaggagagaaatctgaacaaaagagagaaaatagactgaaaaatgaaccatgcctcaggtccatgtggaacagtaacaaatgactcaacatttgtatcattagaggcctagaatggagaaaagagtgacgctgaaagaacacctgaagaaataatggttgaaaattttccatgtttggcaaaagacacaaacttacagcttcaagaagctgagcgaaccccaaatagcacaaataaaactattctttgggaataaagggaaaataaagtcatcttcagaaagagaaaaacaaaaagaatttctcactagcagaactgcctttgaagactggctaatggaagtaataaaagatggaatcttggaaaaaataatggaaatagcagaaacatgggtacatacaacagagcatcactcccttgataagttctataagtcatattggataactgatacaaaaactgtaatagcattaatcctcaaaacaatactatttaaaagtggggaaagagacccaactgaaattaaggtttccatatctcattccatgtaatggtattgatggcagtgaatggtggtaagtcacattatctataatgtgatacccacaatgaccgtgaaaacaactataaaaaacacatagaaggccaggcatggtggctcatgcctgtaattccagcactttgggaggctgaggtggacagatcacaaggtcaagagttcgagaccagcctggccaatatggtgaaacctcatctctaataaaaatacaaaaattagccaggtgtggtggcatgtgcctgtagtcccagctacccaggaggctgaggcgggaggattgcttgaacctgggaagccgatgttgcagtgagctgagattgtgccactgcactccagcctgggcaacagagcgagactgtgtctcgaaacaaaaacaaacaaacaaacaaaacaaaacccaaacactaaataaatcaagggtcttaaaaatcttaaaaaatgttcaagtaatcatggaaggcaataaataaataaccataaacagaagacagaaacagaaaacaaataataaaatggcagacctctccctaacatatcaataattaccttaaatataaatggtctaaataaaaaaattaaaaggcagagactaacagtttttattaaaatgacaactatatgctgtttacaagagattcgtttcaaattcagcaacacaggatgaaagtaaaatgatagtaaaagacagatcatgcaaacattaatttaaaaaaaaacaaatggttacactcatatcagattcagagcaaagaaaatcgcaaaacagaaaaaacttatataatgataaaggaccaatcaccaagacatagtaattctaaatgggtatgaaccaaatgatagagcctcaaaataaatgaaacaaaacctgataaacagataaatctcagaagcagacctatataaatattctcaagtgatttttaacgtatgtgaaaaaaacaattcaatgaaggaagaacatacctagaaaatacataaggaacccttaaaactcaacagtaaaaaaccaaatggactcttggtttttaatcccagagaaatacaaactttttgtttacaagtaacatcacagttaatggtaaatattatagtctctctcaataaaatgaggaataaagtaagaataccttctaccaaaggttctagccagtgcaatagaggaacagtaataaataacataaacattggaaagaaagaaacctgtcttgatttgtagatgacatagctgtttactagaaaaccctatgaaatctactaaataactactagaataagtcaatttagaaaggttataggatataagatcaatatataaaaatcgattttatttcaagatagtaataaacaagtgaaaagcagtatttaaaaaataccactaatagcattagaaacatattttaagtttattcctaaccaaagagtacatgatttcaacattaaaaactataaaacagtgctgagataaactaacaaacatctaaataaatggagagacgtacggtgttcaaggattggaagaatatattgttaaaatgtgaattctctccaaattgacctgccccagtcaaggcaacccaaatcaaaatctctgcaggctttgcccttttgtttgtaaaaattaactgattctaatatttatatgcaaataaaagtcaaagcaacctaatgaaaaagttgtgggactcacagcatctgatttgaagctgcagtaaccataacagtgtcattttggcaaaaggacaaaacaaattaatagaacagaatggagaatccagaaacacggctcacacacagattgattttcaacaaaggtgcaaaggcaattcaatggggaaagaaaagtctctttaacaaatggtactggaacaaataaataaaactatttagaaaatgaatgacatccactgtctaacagcatcacaaaattttattggtggtggatcacagatttacacataaaagttaaacctatattacacaattagaagaaaacataagatatttgtggctttgggctaggcaaagatataaaaggacataaaaaaccataaaagaaaaaataaattagacctcaaaaaatgaataatttctgctcaccagaagacacttaagaaaatgaaaacttggagaaaataatcataaactacttatcagaaatgggccttttatatagaatatacagtattccccacttacccatggggaatacgttccaagacctccagtgatgtctgaaattgcaaatagtactgaaccctgtatatactatgcatgatttatttttccttcttcacaatttcatagatacaatactcatttttaccatagattttagcaacctcaacatatgatttttaaattctttccttaaaggaagcactttccagcttctctttggcatatatattcgaatttccaacatcactgctcttgtgctttagggccattattaagtaaaataagggttacttgaacacaagcatgtgatactgcaacagtcgatctgataaccagtagactaaaagtggtgggtagtctagacaacaacgatatactggaaaaagggataattcatgccctgggtggaaaggtgggagatttcaccatgttactcagaatagcatgtaatttaaaacttaagagttgttggctgggtgcagtggctcacgcctgtaatcccagcactttggaaggctgaagtggaagaattgctagagtccaggggtttgaaaccagcctgggcaacatagtgagaccctgtttctacaaaaaaataaccaactaaaaattagctgcacacctgtagtaccagctactcagagggctgacgtaagaagattgcatgagcccagatactcagaggactgaggtaagaagattgcatgagcccaggagtttcagtttataacaatctgtagtcatgctactgcactccagcctggatgacagagactttgtctctttaaaaaaaaaaaaaccaacgaaccaaccaaccaactctccctgccctgcacccgccaacacacacatacatcaaaaaccctgaattattcatggaattttctacttaataaatatttttggaccactgctgaccaaagataactgaaaccaaaaaaaagcaaaactaaggataagacatactgctatattttaagaaaatatctatagtcaatagaaatacaaaaatccaatattaaaaatgaggaaaagacacttttagttaaatatgcacctgctatatgctttggaaactccactcctacatgtttgcccaggagaaataaaacatttccacaataagactacacagctttattcacaatagtcccaaactggaaacaatccaactgtccaccaacaggtaaaaaaaaaacactttgcgtattcatataatgcaacactactctataattttttaaaaggcactataaatcaatgcaataacatggatgaatctaaagagtcttcatgcagtacaagtacataagattccattcataagaaattctagagcagacaaaagtaagctacagtgacagtaattaggacagttattgtctgttctaatgggggatggagattcactggaagggaaaacatgggaactctgtgctgatggacatagtctacaccttgactgaaatatggttacataaatgtaatttttaaaaactaacccaattaagccctgggtatttcactgtattcaaattttaccccacacaacatcgacaccaccattattaccaccacattgataacattcagagagcagttagggaatcacattattttgaaaattagtaagtaatgggaaagaattaagcattatcgtatatgatatgtacatatttatatacatgtatacagatcctatatgtggatctgtaatttagggtagtcatagagttgatgagaaagagtttttcttaagaagtattacaggtaataaaggaaggaggaataaagaattcgagtatcacaattttgtaaccctcaatgaattagcagatctaggcaatcagaatccacgataaaaattactagaaaagacagaaagcgagtgagacttttaagttattcctacaaaccaacatctatgaagtatttgggaaggaaataaactctgaatctgtttttcgtttttttgagatggaatctcactctgttgcccaggctggagtgcagtggcacgatctaggctcactgcaacctccgcctcccaggttcaagcgattctcctgcctcagcctcccgaggagctgggattacagctgcctgccaccaaacccagctaatttttgtatttttagtagagacggggtttcccccatgtttgccaggctggtctcaaactcctggcttccggtgatctgcccgcctcgggcgtttttgcatgtattttttcaggtgctgaaaaagctctccctgatttcatttcttgttgactgcttagagacatctttccaaatgtccttccttgtcactttttcaaagttaggagcagggattgcacgtttttttgattggtaatttttgtttcaaaggtttgattcagattcagagttgattttgctaggtatggtggctcacgcctgtaatcccagcactttgggaggccgaggcgggcggatcaccagaggtcaggagtttgagaccagcctggccaacatggcaaaacccttatctctactaaaaatacaaacattagccaggtgtagtggtgtgcacctgtaaccccagctactcaggaggctgaggcaggagaatcacttgaacccaggaagcggaggttgcagtgaactgagactgcgccactgcactccagcctcagtgacagagcaagactgtttaaacaaacaaacaaaaaattaacaaaatcttatttctagtggtttacatattaatgatgctggcaacttttagttgaaatgtattaaacagcctcgcagtttttatttttatgaattctgcatacaataaataaataccaaccaaaatatctatacaggcataccccagagatactgccggttcagtttcagaccatggcaaataaagtgattatggcagtaaagtgagtcacacaaatttttttgtttcccagtgcttataaaagttacgtttacattatactgtagtcaagtgtgtaacagcattgtctaaaaataagtacattatcttaatttaaaatcattgctaaaaatgctaatgaagtgagcacattttgttggaaaaatggtgctggtagacctgcttgatgcagggttgccaccaaaaaaactcagtatctgcaaagtgcaataaagtgagatacgcctgtaatgtcttttttctcttctgttattacaagcactactttaagtcttcaactaccgaatacttgtagactatttaatgaattaatattttcatcatatttatattgagaaaattaagaagctgaatttagttagaaaaggtttagaatatcatcaactcttgaggatgagttggaagctactttatctgtcatttttcacataacactagtttgcccttcaaatcatacatttaaaaatgatcttaagatacataccaagtagggattatgttgttataaaaagctagaagtaaaattaagactttaatttcaaagataatttctctataaagaatagcacaagatatgttcaactattctcagagatgcatcaagatatgactttttttcctactagaaattatatctatgatcaatcatattacagagatattgctgttatactccttgtgactgatgaggggggtttttcctatcaccatgttatcccaaccctttaatgaatcacctttgaaactcagaacaggtagcagcacagaggttgctaagagtaaatacattcaccactgctgccagaaatgaccaacggtgcaccagaaagaagaaatactggtgaattcccacataccacgacgaacaaccttataaaataacagaacaaatgaatataaagtaacatacagccatcccttggtatatgtgacagggattggttccaggaccacgtgtgtataccaaaatccatgcacgctcaagttctgcagttggccctgtgaaactggcatgtatgaaagtcagccctctgtatatgcaggttctgagtcccaccaatactgaatctgctcttagttgagaaaaaaaatctgcatgtcagagggcccatgaagttcacagctgtgttgttcaagggtcaactgtaatataaaaataacatttattgctagatagagttgatattcattctagtgtttatatacttgagtcttagagcaatagcctttggagacaacttccaggaaggtacgtgtttgcatgccttctcactgcaatccatcagtagctgccacttgaaccagtcttagcaggggatggggaagcctatgtctttcagaattggatgatgtagtacacagaagtagacagtagagtagtaagggcatttgcttaaaagcagatagaactgggaacctctacatctttctgtgagaattcagggcttagttttttagggtgtaaaatggaaatactagtatgtatctggacatattatcttaagaattaaataaaagactaccatttcactcaaaaagtgcttgatcctgggaagccatgtaacagttcacaaatgcagagttcaaaagaaaggaaaaattgcagacatggtagccttattttaattatcttctaaccagcagtaagcatactctaaccagtgaggaatactagataatccatacgccaaatgcaggagattacatgagacttatatataacaacacttcattcatgaaataaatcacaagattagctctgaaaaatggtgattatattacaaatacaaatctaagtatatagatgacaatttgtgagtttgcttatttgggaattagtacctagagataaaggtctgaagcaaaatcacacacccctttggtgaatcaaatcttcctctgaagaactaagtacctcacctaatcagaacagagtccctggtatagccaccgtcatattctgtagtttcttctagtgcttggaaatctagattctgcaaattcaagaaaatatgtcttagttatctgctatactactgtatcattacaaacaataaatcgatacatgactttttgcagacacctgctttcttacccggcttccacatataagcaattcaatttcttctggtctgaataagtactttaagggagattcattggtcaccatatgaaaacctctccgaaaagccttgaactgtttttctactgatttattgagaatgtagtcagaataaagattgacaaattcctgtagaaaacattaatcacaagaacttcttataatatgctatgcaaacaaaacacaagttattgggctgcatagctttttaatttttccaagaaaaaaacattcaagaatattcttaaaaattcaattttacacctacttcttaacaatttcacaattctctgttatagccaatattaagctatgaaaaggccatatacataaaactgtcaagaatattcttaaaaattcaattttacacctacaaagaaaactacttcttacaatttcacaattctctgttacagccaatattaagctatgaaaaggccatatacacaaaactgtcatacttataaatgtcaatttcgataatgtattaaacagaactgaatataaatgctggagacgcagaaaattctttaggttctctcaactaggtatgtaaacagacacatttaaaccatgtatccatctatttataaatgccaaccgttttaagagagtacaatatatttgatttaagcaaaccaggaagtcccaagttttctaccatagaatatttggtaagctgcctactgtatccagttcagcaaaaatgtggaagtactgactgacacataaactactgtatcaaatcataaaaggaaaatgtgctttgtacccttagtgtgtataatatttaatcaaaaaattatatcaatataaacatgtttcttaaaggtatactatatatttgtcataattttttgcttgttatgttctgggttattcccattcccgatgaacacattttagtcaatagaaacccaaatctgacgtaaagtatacttttcagaaatgtatttttatcacaaacaggatatacatgtgtaaattaaatgtaatttttatttgttctgtgataaagaccttaatcatgaggttcctgcttacagcttaatacaagaaacaccctgcttcttgctttatactacaaccacacttagctattaactatctcctgcttcatgtcctctttctctaaaaggggctttagtgcccaactgtgtgctttcataccaacttatatccaagatttagaaaagtggactctagcatttacataaacttagttacttgttttttttttgtacagactatattagatacttctttaaaaattataagcatacatgctttgaaagtgttaatgaagagacaaaatgtgacataaaaacatttattaccttcctgttttcatttgtaattggaattttatcaccattttcctttagatcatacatcattgggttaccaaaaagatctgtctgtgatatctggaaagtgatcatcatgtcatcttccacattcccttcatactccaataaatcttttaaactctgatatagaacctagcaaccagaaatggtaaattgaggccaccatagaactacaaaatacaacaaataatttatatcactcttcttagaagacaacaaaaatcttatcaataaaaattgtaaaaagtgtagacagtatccctccagtcccccaaatagtttccaacctataaaagaaagattgtcagtcactgtgatgtcccattctctgctgagaaaccccataccaccaatttagcaatagaattcacactgtgctctatgagaaattctgtggtgtctcaaggtgggggtgggggtggtaggagcaggcacactcgttgtaactaccaagacccttagccagggctactctgatttttacctatctcttaagatttcactaaaacacaaacaaaatgtttagaaacacttctctatgaaatcaatcttacaaaagcttcgtgctgacagcaatatataaaaatgtccccctttgagtttttaagtgtttctggtacttcggtcagattaaaacatttttatcttattgataagagtatcaacaaagattctaaacaaaaactttaaaattttgacataaattaaatttttgcatttaaataaaatctaagagactgaattaaaaaaatgacaaagaacttactgggtgagagtctcccaagtcacgaaaagttccttttttccccattagcttcctgtagacaaccatgggaaaatgtacatccagtatacagttattgtaaatagccagacccagtactatgccaatcagagtaaactgaccctcagtttcaaaagaagatggattaaaccaaaacaattttgtagattcatcgtatgtgaacatacctataagaaatgatttttaaaaatacattacttttgtattttattaaggactgatgaataatacaaatataaacttaaaataattatgcatataaaacatttaaaatatatgtaattaggcatgcaacattgatttctattatattagcacttgagaaaacaatgtccacatatatctgctataaattggggtgaatggtgatatgtaattttatgaagccaaaggaataaagtagtaagtaatttggtggcatcgggtagaaaaatacgttaattaaattcaagctttctaattttctactaacacataagaaaagttatattcatgctttatccacccatagctgaaaaataaacataaaaaaacaaaaaatggctacatttccaaagtgtttcatttataaaaatataattacttatatctgtaccacacgtactatttttgaaaacaatttttcatttttttccttgagatggagtctcgctctgttacccagggtgggctggagtggcacgatctcagctcactgcaacctctgcctcctaggttcaaacaattctcctgcctcagcctcctgagtagctaggactacaggtgtgcaccaccacgccagctaatttttgtatttttagtagagaaggggtttcaccatgtttgccaggatggtctcaacctcttgacctcgtgatctgccagcctcagcctcccaaagtgctgggattacaggcgtgagccaccacacctggcctaaaaaacaatttttaatcacagtaaagaaaggttcgttttttcaaaattagacaatggtgccatgaaatttttctagcattttcctaataaaatcagatgatctgaaatacataaacctggataaatctgatgaacttagataaacaaagctattcaatacacatgttaattatgggccaatacgtaaaagaaaagtagtttcgtagtctttcaatttcacatggtcttcactatgcaagccccaatcatggaggcttttttttttttttttttttttgagacggtctcgctctgtcgcccaagctggagtgcagcagcactcagcttagtgcaagctccgcctcccgggttcatgccattctctggcctcagcctccggagtagttgggactacaggcgcctgcgtggaggccttttttatatcactcattggaaaattggggcccggtgtggtagttcacacctgtaatcccagcactttggggaggctgaggcaggcagatcacttgagctcaggagttcaagaccagcctgggcaagatggagaaaccccatctctacaaaaacacaaaaaataagctgggtgtggtagcatgtgcctatagtctcagctacttgagagggtgatgcatggggatggtttgagtcttcagcctgggaggtggaggttgcagtgagccgagacagaaccactacactccagcctgggcctcagagccagatcctgcctccctccaccaaaaaataaaagattaaaaaaaaggaaaattggaatctttggaatgagtactactaaaaattgatttcttcccttttaaatgactaaggaaaaaaattttaattgaatttaaatcattttactacatgtttagttgctactgtgaaacaatgaaaacatcttaagaattaagtctgaaaaaaatctgtaatttccaatagaaaagtagagcttagaaatcagaaatcaaattatacagtatataagtattttaacctgtttataagaattttaaaatctttgaaaatgtcattgtcactttaagtttaaaaataaggagctttaacatgtttccttgatcactaggagtatgaattaagcttaggacattttctgaatgcaaaatggtttgaaaattaaacaattcatatttgagtttcatggtttctatctaaacattttttttacaggccaagttacaacatccatggaaatgcttttagttataagtatggtattaacaggatcaagaacagctgacaaataattacaattaataaatttgttcaagctgacaatggtgtgtctaaaaaattaatgaatttaataaaatgtcacaaatgcccttccttggaaccaagagcaacaagctataagttaatcagaatataactctgaagttccattttaggcacattttctcatgttccagggagaaaagcaccataacctcctggtaaaatactcctttttgatacttctactgccatcacttcagttatcttactggaactgcttaatctatgttttttcttacaagtatttctgcatataatgcaagtatgctttatagctaaggtttaacatttctagatacatcaaaagctagagctaaggtttaccaaatttaagaactttatgaagtttataattttctatctcaaaaagggcgtcgtcttatgtatctctgatttacttagaacaaactacatacaaatggcatagctttttagttattaataaaacactagctagattatagataagggatgcgtgtgtgtgtgtgtgtgtgtgtgtgtgtgtgtgtgtgtgtgtgtgactaagaacagtaacagaaaggtcaactcaattagaatcaacaggctataacagctcaaatctcaaagctgaagggaaatgacatacattattctatgcacactcctcacaattctgatggtaccttcagtggaaaccttttcctgtaattgtcatgtactcaattttaaacgtaagcaagctcagttactaagtggttatatttacagtagaaactgaaccagttcagaattatgaagttaagtagactacccaaaagactgcatcttttccctgttctactttatcacaaaagggaaaaaactaaaattctgatccttcactttcaaatttccaaatcccatcagcctttcccaaactgtgttcaataacaactcttctgttagggcagaaaaagagttctggagttcaaaaagtttgggggaaacactacctatattaagccccaagaaatcttatagcaaataaacctaattaatgtgatatcagctagtgtttctgaactttgagcatgacatacttgtgagacagtctctcaatactcttcaaaccattgttctttgaagttcacaggtcaggaaaaccgtgagtttgatgatggttttagacaacaaaaagcaaagaaatccctccaactgttccaatataccattctaaagtgctttcaattcagtttaccaaagagataatttccttcattagaatattccttctaagaaataaaagaatttgaataaattagtgatacaaatcagttcctaaaacctacaaattcagtcatgatgtgtgattctgggtaatccataccaaatccttcttttgctgctcttcatagctgaaaatatttacaaagtaagataaacaaataactaactcaaaagatgatacgacaccataatcacattactaatgtatttaccaatatctggattgaagatttcctccacaaccagctgaaaaaattctttggaaacacctccctcatcaactccttgttctccttcaaattccacatacaactgcttcttcaagtctgcaggattttccatagcgatcatctctagctagtgattgaaaagataaacatgaaaagaagatgattgctagtatcaggaaaaaaacaaaataaaaacaaggagtaggattaggaaacaaatacaaatttttgactttttgtatgtaaatggaaacagaaagcaaactgataaaaagccagtgaagacaaagattcagtcttaaagataatcaaaaagacagacacaaaacagacactagcatagtaaaaagctaactttactgatttgttatgaaattaacatacaattaattaagattttattacttgtgtgttaagtctggactacacaggacatggaaaagcagctaaatcatttcagcaaaaacaatggagtagaggtctaacctcaaaattgttcattagtagtcctttattagaatagaaactcaagggttaagtcttagtatctactaagtcataagtaaaatatttcaattaagaaaaatacactgaatactaaagcagtttatggtctctcacagtaagacttagtataaattaccaccttttaatggactagaacccatcttatatccacatttccttaaaaacaggtgagacataaccttactcatgtccttactctttttttttttttttttgacatgaaatctcactctgtcgcctaggctggagtgcagtggcgcgatctcagctcactgcaacctccgcctcctgggttcaagcaattctcctgcctcagcctcctgagtagctgggattacaggcaggcgccactacgcctggctaaattttttatttttagtagagatggggtttcactacgtttgccaggatggtcttgaactcctgacctcatgatccgcccacctcagcctctcaaagtgctgggattacaggcgtgagcaactgcacccagcccttattcttaaattgtaagttaacaaactttagtgtctagcattttctcaactataaatcttttaccaaatatttttgtgtacctatagaattatgaatatacagtaacctcattgagattaatcataaaatcaacactagattccaatattaactgtttatactgcattttgtttgttttactttatgtatctaaaatttgctaacagtatgactgtatccagtacatggatggatactgtatctagtacatggatggatactgtatccagtatccatcatatctcctaacttgccttcaaacatctgttggctggttaaaaaaatttaatcttggagatgaaaatttaccaaaacaggatattaaatgttttcaggttattccaactatttcaaacagaattttaaaaatggttttgaaaaatgcaataatcactgaaacaactgtaacacagcactatagtagttaaagtaataatactcatttggacaatctagtctgtctacaaaaaataaaatctcataaattaacgcatcaggtcaggttgcccgagagcattgttttttcaaacttgtcacctgcaactcattagtgggtagtctaatccatttagtggtttgcaatcagcaatgggaaaatcagaatgcattccacatagtaatggaacctactgttttgtgaaacttttgtttcaattagatgtacagatggataagcatgtactgggatgctatgtaaaatactagggattgcagtcaaagagtttgacaaaactagctgaaattatcttctgggtatcttcaactttagggtcctattctgtgaatttagtctttagctttaaataatgtctgttgttgttcaacaccgatctctaatatttacaaaatcatttttaggccacacagtttacttttagacaatgttttgttatggaaagaccaagagtcagtcagaattcaccttactagtcccaactctcacttaccataacttttaacctttaaactttagcacgcgattcaattaagcctcagtttcctcaacatactgtaagttgtgaaggcttattaagaatatatgagaacgagtgttaccttttaaaatagttttgctctctgaacaacagatttgcaattttgtgtccccaaaggaacttgatatagactagttccaagatctagagtcaaacaaatgtagatgtgaaaataaccttggggaaaaaaatagtttcagttggaaacctgtttcaagctacggagtatacagaattctgaggagactaaaattagaattaacatcttagctcaaatgtgggaccaggccaacattccatattgccatgtaatccattctgagtttccttatgccagttcccaactggctaggtgttaaagatgtaagtcagtgtttatatttacctttacatccaaaggtatacttgcttttatcaaatataatgtattccaaagtggggaaaaaaaaggttatctggtatttagactgtgcattctacagcttttccccactaacattcatagatgagagctgactccttatcaatgtaaaaccttttaaaggatgtggtggtgaatttctacaggattgagaggccctgtgttctatctagtcttagctctacctaagacatgtcaaatgataactgaagcaaatttatctttattctccataaaatattacatgtctgtccacttccactgatctctattctatgctccccaccttggtgccaaaagaatgtaatgcaatgcaatatgttctattgtaaatgcaaacatacaactttacctctcttatttcatctgtaaaataaccataataatatagtaataaattaatgtatgaactgcttagattaattccctgcataaagttagtgcttaaaagtactagctgttgttgctgttattttattggttctaaaatattttctgaaaacctaccatagcattatagaacaaaaatattccatgaatacagcaacaataatatatagcacttttgtagcatttcacacatagcaactaatttaatcttcacaacacccttatgaggaaggaaacattaactccactttacagataaggaccccaagatactgaaaggtgaaataacttcaagtcacagtaagtcacagtaagttgtggaacagagatactaatccaggaaacaagctcttaactactatgctttactcactctcttcaatgacgaccaaaaattttttttttaggattatgagtgatttttattttccttattcttttccatatttttccattttttacaacaaatacatttttcagagtcagaatgtgttcaaatataaatatgtaaaaagaataatttgaaaagtagttggtaactgaattctgtaggcaaaaattttgttattacctattttagattaccattctggtacacataagtgatttcataaaatactgtaccacttaagaataaaggctgggcgccgtggctcacacctgtaatcccaccactttgggaggccaatgcaggcagattgcctgagcccagcagtttgagatcagcctgggcaacatgatgaaaccttgtttctacaaaaaactaataaataaataaataaataaataaataaataaataaaaaatagtggggggtggtggcatgcgcctgtcatcccagctacttgggaggctgaggtgggaggtcaaggctgcagtcagtagagatcgtgccactgtactccaggcctgggtgacagagttaagaccctgtctcaaaaattaaaataaataaaatagtaaaaacagaatacataaatagcctttaaaactattttattttaaattattaacacataaaatttagcaataaccattttgataaaggccattattgcataaacagctgtactgataattctttttcttaaaaataacctccatcaattgttcggtcaatttaaaaaagatttaacaaataaactgtaaaggtgtattctttacataatagctatattatttaaaattgtatgttgttgtttaaacccaaacctcaccataaaactgtattttttaagtcagaagttgttttaaatgcattaggatatttgaaatttggaggactatgtctaaacattctgaaaaggagaacgtgcatgcatgcctgaatttatttacaatacacacgtggatttttagggttttttttgtttgttttttttttttttttgagacggagtctcgctctgtcgcccaggctggagtgcagtggcgcaatcttggcgcactgcaagccccgcctcccaggttcatgccattctcctgcctcagcctcccgagtagctgggactacaggcgcctgccaccgcgcctggctatttttttttgtattttttagtagagatggggtttcactgtgttagccaggatggtttcggtctcctgaccttgtgatctgcccgccttggcctcccaaagtgctgggattacaggtgtgagccaccgcgccaggccaatttttaggtatatttaaaagtacagtgtatgttgtatttatttaacatggagactagcaacagacagagattactggggaaaaataaacaaaaatatcctggatataatcatatctacctcttcactgcgtaacttcctcttctttaagactcttgatttcatcaattgctggataaaatgatttttaatttctgaactttttaattggccatgatgatgaaatcctagggagttcattttttaaaaaaaaaatctgacctgatatcaaagcatttgcagaatacctagcaggatgacatcttaatatcaaaatatgatattactagacttacaggaatcaaaaggaaaaccttatcacttaaaatcttatagttttctgagctattacatcaaatcaattcataattttttaaaaaaattccttaataccatgaatatttaagtagaagcaataatcagataaaagagacctctaatacttaagaatgcctgggatttctaagaaaggctagcttcaaggccgggcgtggtggctcatgcctgtaatcccggcactctgggaggccgaggcgggcggatcacgaggtcaggagattgagaccatcctggctaacacggtgaaccccatctctactaaaaatacaaaaaaattagctgggcatggtggcaggcgcctgtagtcccagctactcgggaggctgaggcaggagaatggcatgaacctgggaggcggggcttgcagtgagccaagattgcgccactgcactccagcctgggtgacagagcaagactccgtctaaaaaaaaaaaaaaaaaaagaggaaaaagaaagaaaggctagcttcaactacttcagtcaacttgaggcttaaactattgcttgagatttccagattatccaaattaattttttcatgttcacgataaacacatgaagaaaagtctgttatatctcaaatgtagtttaaatgtttgggtaacaccaaatcacataatcacgttcgtccatgagacctggaatcctgacttctatttccaattctgccattaatttatgtaggctggaatctcttttagatttcattttcctcacatgtaatactaagtttgatgtttcattgtcttaaattattatataatgctgaggatctatgtatatataggcttcattctctcattcagtttctgagaaattactttgagggcataaaccaagcatatttcttggtttcatttttgatttcaattagaataaatcacaagaaagaacaatggaaattacatgttaaccacaatatagtgtatgtgtaagacaaaattaaacatacctagtgcagcacagaataatctcatttttaaagctctgtgagtcaatgaataaataaaagaattacgttcatgtttcactagtaagagtgttcaccaatgctggaagctgggagctgaaaatgctggaagctgggttagactaggctattagaaaccagataaaaagggccagtgacttttagaggggattttgcagaacctcctggtagtggggctttttatctgtgccaatcacctttatctgtgctaattcctatttttgaacttccctattcaattccacatctcagccattccttttggtttttagatatttatgtgaaatgctagaactccctgactaattggaaccaagtttcacatcatcatcatcctctattccaagcttgctgtccccatgatcctcttaaaaatctgagtttccaaaacacataaacatacttgtatatcaaaatggcctttctctttctctctatatatgcacacatacacacataaacacacatgcacacacacccccacctgagctgaaccaaaggccatcttcccaaatattggagtctggctttatcaaaatatttgtggagtattaccagaagttcagattcataggctctacaatacagcttctaatctaaacctctagaggttagggccctggattttatttatttatttatttattttttttaaacaattttcccattcagatgtgaaggcagtttgagggacctcatgatggcaatactatattcttccataaacttataacctctatcttctcctttaagaagtaatttaaaaaatcttaatacatactatcattggaagtgcttcatctaagaaaaatgagaaattatctacttgtaaaagaacacacaaatgggtatatttacatatttgtaaatatgtaaatatttacatatttgtaaatatgtaaatatttacatatttgtaaatatgtaaatatttgcatatttgtaaatatgtaaatatttacatatttaaattaaattaatttacatattaaattaaattacatatttatattaaaaatgtaaatttgtaaatatggttttacatatttgtaaaaacctcatcacattaggaatgtcattcaaatgaaaggtgaagtctaagctcatgtttatcactgtactgttttctaaggaacaataacgaaaaaatactgaaaataagtcctaggggaactatggcagtaagttaaacgggtagggtgggggtgttcttaagcagttctaaggtatttgtgaagagacaacttatattctattgattctaaaattcacttttttcacattatctctgaaatcagattacaccatacaaatgatagcatcttacaatgaattgctggtatttttctgtcttagcagtaataaaatgatagtgtttcctacaatcagagattagtgaaaatactatcaacatgaattcttctcttgtcatcaaagacaatttctctaaaaacctcaggaaaaaagctgctagtctggtttgaatttcacaatatataaaagcaatgaatatatttttcttttttaaaaaaatccacaattattaattcaagttaccactcctcaacagaaaacatacaagagtctcatatatgaagtcactattttctgggcttgatttctaaactaaggagtggataactctaaggtttcttttagctcttaaagcctaggatcccataattttatttatcaatattaagcttaccacaaagtttctcatttcttcttttccacccaaccctgctatacaattccaaaattagcaagtcataaaaaagtggccactagtttgttcactgtgatatataagaatgaggcttaaaaagcagagatccttgggaaataagatcttgaaaaattcatcacttttgagctttcatatgagagaataatcttaaaccactttctattatagaacttctactatgtgttactaaaatatgtggctttatcataatcatcacctgctgtgaatacttacttcaaaaaattacacaggttatcaattttacttataagacctatttcgatgctggtttttctagtcttttcacattctgttatttttttaaaaaaaagaaaaggaagaaaaagcaagggagaaagaaagttaagagtaaaatctgcttagtgtgagcattcagagcccctaaggaagcttctctgtaagcatcatctctttctattttcacagtttattaaactgcctaacacacatgatttctgaagtgaactgcttttgtgggctggcaatattcaagtacatatactatctagtgaatcctgatttatgataggccacactatattatctaattttgatataattaagcagaacttgctaaaaacaagttaccataattaaagagctcacagttaattttacactaacacctaaggctttaaaagcagttgtttccttaaaattctagaatagaatttaaaatatagaataaagtatataccaagtacttaaacttttgtttttagtcttgctttactagagaaaaaaatgggggactgaggaaaataagactgagtagacttctgagcgaaagacagataaggaaggtagacaattttttgaaccctggaatgattcttacagtgtaatttcattgccttttaaaggctagacatagcttttgatgaagacagctgaagggatctcacctcaagaagccaaacataaagtatgtagctttggcatttgcagttctgctccaacaatggatagtcatagacagacctcaacatacctttcataaaacatcactcacattcttataaaataccctatcattctgctaaactatgtaaagtaaggtgctggctgccttatgatcagtcattaagtgtattaattattcatgtgtctcaaaactatgtaagtgaaataaaaagggtaccagaaagcaagcaataataatgacttcaggcagttaaagcccccttttgtctctgctagaaaaccacctgagttgcttaaataatgcagaatctttctccaacactataaacatatctgacattaaaaaaaaaaaacaaaccagtaacaaaaaaaaaaaaaacacacaaaatctctgcaatttttaatttctgagatgtcaaataactttttccaccgggctacagctttatgaattctcgaatttagacaattctaaaactaaaatttagacattctaaaactaaaatacattttaaagtaaaaatcacatttcctagttgtctgtgtcagacaactttactagtatactatagtattattaactaccttaatttttgttgacattaaattttacttgaagatgataaaaaagtagcagcaatgacagggatagctaatactagaaatacaataaagctctgcgataatgcacctgagacaaatgtaaattttggtgaaatgtgactgacgactgctttctgtcttctggccactcttatattcttaaacagatacactaaaattatcttgtggaggaaagaaaaggaacaaatggcaaccccatctggaaaaccaggaagttaggatgagtacctgagtttccagtatttccctgctcaatctccctggacttgatgttacaggcaccactaatccccagatttttggaatagctgctgttttccagaagttccaagacccagagttgtctctatgaatttttaagtgggaagaaactaccacagccaggcagtgccgtccacacagggatattctaagtggcccagcaggactcaactcttactggcaacaggcactgatctgccatggtcacttcatcaagtccacaataatgcaactctgaattttacacgatggaattttttggacactacctataattttatggtatggttttactgtaccattactcccagttcaagactgcacatccacacttattattgggtatctccacatttctcttgttctggtctttgtccaacactctattctcttctgaatgaaagaaactttggatttagttttcaagatttagaaaacccattctttttcaaagatagcatgaccattatataatacaaccgatactttgtagaacacatctataaacttgcacaggaacaacaaaagtataatacttatataagatcagaaatgtccatgtgttcctatgctatatggtatcatttttttcagtcacttttaaaatgaattcactgaactgtatcatgatatccccattattaggtttttaatctagcagcccaacttacccggacaagtgcatcatctatgatatggtcacgtctaactttgagtctcaaatatggattcaactgctgtccttgaactaagctgtagagaacagtgattcttcgttcactgtacatgcgaattctattgtcataatataatcccaaattctttgtgacagcattcaatataaagggacatgtcataaaagagaatttgttctctgtttctactttgaaaaaagtataatctttatccatttctagaacctcattcagtggttcattaataaactcttcaaaagggataagtggttttcgacaatccagggttttaacaccaagttcagtttccagggggtccactcgaggacctttcttgtttcttctttcttctcccaaaagttcctgaagtgtcagctcgctggactcagggatgggctcttcatcatcttcttcattgtgatttgtgtccacttcccctcccactacatttgcatagtaaaccattttcaagcacttcgaagcagcaacaatggcatcatcatcattcactagatttcgactgttaaattcattgcttatgactttataagtaataagttgctgaaatgtctccatcattctccgaatctggtctgcattgtatttagaccacagtctgatcagttttccttgggctgcaaggggtagcttgctcatcgctttgcaaaataatggcaaagccatttccagatattcaggactgtggagatttctattctccattacgataatgaacaaattcagataattaggatctcgagagtatacattgtgatacgtcaagtcacattccacgttaggtgacaaatatacaagtgcattgagaaaggcagtttcaattttttcattagagagcaatctggtgtagacccttctaatggcatcaatatccacagacacatcatcagggcctaatttttgcaaattgttgtctccctgtgagctatcacctatccttgaggaagatgcttctgagtcttcttccatagcagcagcagaacatgcagctttttccttttcatcttcatctttgtcttcatcttttgcttgaagagatttcagttcttccttggtgtgttgtttaactttccggaagctctgtaccaatgcctcagcactagaaaaaactcttccaataacacggattaaaggggaataatcctctctttctctacataattcaagaatttcatataccttctcttctgttaagtaagtcacatctagaaaatcagaggaaaaaagagaacatttattttcataatatgtatgtttactctgttgcaaaaagttctaaaagtaaaacagccaaacattctaggctcaatatcatttatgatatacaactcttaaagtatctaatacttagattcagcaaacaaaatttaatgcttacctatttttttcaatgaactacctacctataccaatgacctcacccatgcttttacattctttcaacaatgtataactcttaataagatcatgagtttaaactttctttataatcaagatatctattaatgtatagctttaattataaatatgaaccaatatgtcatgtactgattaatcataatacagctcttaaaacctcactgtagaacacacagaaatactactaatctgtgagttttcttgtttcagtactctgttctccaaagactaagaaggcaaggtcttaaaaaaaggctccttcagcatctatgtatgtattaaaatcaaactggttcattttgggtcttcctagtttgttccagggtagtcattctgtgagtgattgagaagaatataccatttctcatcggctcttaagtagaaactgctttccacagccaggaatcaggttagactaaatctcatagagtgacagaaaatagtttttgagcaatgaaaacaaacagtgcaaagaagtaaacttatgagctggcaagcagtgcagagactatgtagtcatcaaaatctatttcctcttttcctgggcacagagttggaccacatttcccaactttttgagataagtgttattttcaggccaaggctttctcccttctggctaataggatgaaagatatttcatttcacaggtaaaaacaaatgatatattttgtgtactgaccaacataatactgagaatagtcttaattctcccttttatcaataaagtgacatacttgtcatcatcagattaactacttgagaggttaattttagaggcacacagacaatcctacctccattgcgccaaatatacccttatacatgtagtgtacaacatgtagaatttttaatgactcccacctctgctataatatatgtttcacaatgaaagacaatataaaatgtaagtgatcattgaatggtctccaaaaattgaagcacaaaaataccaaattttatcatactaaggatctgatctgtggcccagctacaagagtaccaacacttacagtttcttttatgggccttaactctttaagaactaattctcaggtttgttctattaagaatatataagcatcttttgctaaacatcagtaacctcttccccaaaagcataaaaccactggaaacctatttctcattattttcattgaaaatttttaaaataccttcttacaagacaatgcaaaactcctaatttcctaaaatgtaacataacagaaaatactactatcctattaggacatgaaacactttgcttcctgagcaagtcataaggttaacaaagacttgctttgcatgcagtaatatggcctgtcctagggatcaccattctagactcacatgtcctttgttgatatgtcatgctttcggaacatcttcaagtgattctgacagtctactaatcctatatagaatgtacctatactttttccaaggagtgttttttgttgttgttttttgacatggagtctcactctgttgccaggttggaatgcagtggcaccatttcggctcactgcaacttctgcctcccgggttcaaacgattctcctacctcagcctcccaagtagctgggactacagatgcacgccaccacaactggctaatttttttgtatttttagtagagagggggtttcaccacgttggccaggttggtctcgatctcttgacgtcgtgattcgcccgcctcagcctcccaaagtgctgggattacaggcgtgagccactgtgcctggcctgtagtgtttaatatgttaaactgaatttttcaggtatatagataaaaattagtcaaaaaacactgtaattagatatgaacattcaaaaagtttggtttattgatacaggtgttctactgagaaagacatttttataagatttcttgtgataaatgtgtccctgaaaatactcaatcttttaaattttgcacttaaaaacctcctacgcaaaaacagtttggtgcagactacttaatacttatgcaactttgtaattagtgttaacaaacataattaataatcaaaataagagtactagtgtacagaaagcatctctaatttccaatatacaatagtaactatagaacaatgcaaaaacaaaaacaaaaaaaccagtaacgaacagggaacagtaacagtagcatattagaaaacagggataaggaaaggtcacaactgctataatgcagacttgagcaaaaagaggagggggcataaagactggataaagccacacaataagcacctctaagatggagcacgtggccaaaagagcagatgagcacattcctcatgtaccacatcccccgcagctggctgcattccactgtgccagcactctacattcagttactggtactctctggtgcacacttactggagaactgtgtacaataaagtcaatgcagcttccacattatactgacacactatatatacagacaacatttacctattttcccatagtgtgtgaactaattcatgaaacagaattatacactctgaagcaacaaagttgtgtaaagtgacgaaaataattttattgtggaaacagagtagaggttataacacaatgccacttcactaattctttcaaacttgattcaaatgatgttagtgaaagttttagaggcaaatgcctctaaaattctctgacttgtatgtcataaaaaaaaagctttctctcttaaaatacaattgcctctgggtgtgtgtaggggtgagagtggaggggcgctaagccctggtagtcattcaaaaatttgattactttgttactaattaccttcactgaagaaaataacttggagttttagtattagcgacaaggtaatcgaattctgaattttggacgtaggaccatttagaaaacaaaagacctgagtgaagactgtcattggtaggtcatgatccttggcagcatgactgtaccaaatgtccggaaggagagtgagaagcatatatctgaaggaaacgtagaattctcacataactatcacaaaattttgtcttgccttcaaaaatggaaaaaacccactgtttcctctttctgcttctttcatcacatcatcctgaggttccagaactcatgccagatacttagtccagttattctataacttaaatagatgttgtggcctagttttggagattcactaccacttaatacatttttcctaagaattttaaaaagttcaaatcaatctattaacaaatgaacttttggcatatgatctgcttctaattagcaatgattagacctgtaaaatgtagttattattcctgtccgttaccacaataaaaaattggttctacgatatcaaaatgtctttatgtcacagaagaaaaaacaaataaaaactaatacatttaaatctcccacatggttttcaggcaacaattctcaattgaaaataaaacatcttacctttaaaatcaattctagcgcctttcttgttcatttttatctcagagcaggagttgttgggggcacctttcgagttctcaaggtaagctgagcttgctcctttcttggagggatgaggatcacagagttttgcattaatcttataaagctcgagggctttaatagctgctgcattattatccatacgaagaaaagttggacaggaagcacaaaactcattcgtgcaggcttcatttccacagccctcagttaactggtggtagtagcgttctattagatgctttgcagctgctcgcttcctgtaccaaacattcaaacaataagcacagtgattagtacagctctcaagtacaaagctcaacatatcatcaaggcaaaagttagtcaagcactgaagtgattaacctgtgtatgaagatgagaagtagaaaatggagatgcactatttaccacaactcctgactagtgaaatagttaataaatattttctaggatattatgataaagaatgtcaatgcttactgactgtattaacagagtatacattcctttggtttaaaaggggggaggggggcttgtctgatggtatatgtgcttaagttgtttagtacaacagctgaaaaatcacaaggtttacagctaagagttgtaggattctatcattttaaaaattagcattaggaaaatgagtctatttaaagcatcaatccggttttcttttacataatcagtatttcatttttaacagcttgtaaacatttgacttatagttaacacagaatatctatctggaataaaaactatttttcccaattatcaacaacatgggagacttaaaaataaatttgtaagtggaatatccaaagatagtgttacactgaaagaaagcggctgcagcctgagtgaggcagatcatgactgtaatcaatcccataactgtgggaggctgaggcaggccgactacttgagcccaggaggtcaacaccagcctgggcaacatagtgaggctactctctacaaacttttttaaaaaaaattagccaagtgtggtggcatgcacctgtagtcccagctacttgggaggctgaggatcacttgagcctgagagtcaaggctgccataagctgaaattgcaccactgcactccagcctgggcaacagagctagactttgtctcaaaaacaaacaaacaaacaaaaaccaaaaagaaaaagaaaaagaggctccaaagtgtagaatcttaaatctaaaacttgtcactaaacctcctcattagttccacgtcacaagatggaatattttaagttccatcacgtgaaatcttatattccttttactctgtcaacttaaagtacacagattaatgtcctattatggctgtttcaggagagctaccaaaactgagggaggaattatgtgaccatgtaagaagttagatgacattatattcaacactaaagagtctatgcttctactaactgataaaattaccataatttcagtagaataaactactggatccaaagaaacataagtcatagccattccttttggtcccaaattcacaagcatggaaataacaactacaaagaatcaaaattataagaaaaatagttcagctgattttcaaaacattcacagaattatctaacatgtaggactagatgaccaatgccagagtttacatcttgctaatcatgagaaactcaacaattaacaaggcagcaagtaagtgaagaaacacacgagatccaattttgtctcaacagaagaactttcactctctgtccaggtaggtgacaaaaagtgataattcacacacattcaattcattctggtgcttatttttcaaatgttccatgcaaatttaccactcactgcatgcaaacagagaaaaaagaaaacccacaaagcacatgtaaaaattgcataaacatgacttaaagacattttgctatctatgaagctataaaccccacctgaaaattaaaaactgttatcacagatttagcactatgcaaaatatgaaagtgaaaacatgtaaaaataaaatggaaatgcagaatctagaaaatttaaaatatatattgctacccttcagtaaagaaagggagataatgtcatgttctcccaaactacagtgacttccctggtgaaaatgtaagtaggtatttcctttctggaggaaaacagtgaacatgtatcgaaagtcttaaaaacacgaataccgtgtgaatgagatcctacttgtggaaaataatttgacaattttacaaaaatgcattgtttctatatctgaaaaaaacatgtctaataaaagattacttaaatgaactgataataggtcacacaataaaataaaaactatcaagatttgaattcgacaaagaactgcctagtcttcctgatatatcactaactgacaaaagtcagttaaaaagtagcaggtgtaggatgaacccattgttatttcaaagcattaatagcattttctctggatgatgtgattaagtgagttttaaaacttcttccatcttttgatttcttatttattctttccatagtaaggatgctacttgcatattaaaaattaataactataaggggaaaacaatagcagttataaaacttcatatacatgatttgaatggccccgagatttactaaattgtctctgatttttaaaaaaattacaaaagtcaaaataccaaaatagatatttttaatgtgagcttttatactaaaataacctccccaaaacttgtcagatacatagtacttctttatatactacataggaggagagtgatcagcacaaacagaacgagactgaaaaatcagaagatctgcattaagtgtcatccttctgtccctaagcagctgtaggatcctagggaaacaattgtctgggcctcagttttcccagctttatgagtcccttcagttctaattttaaagttattttatgtaatagggaggtgagcaagaaactagtatttgctggatgcctgataacttattacacacactgcggggcactttgacatgggttatctcatttgaataccatgacattgaggattatcttcagtccacagccaaagagagaaatagaactggagtcaaatcacgaaaccaagatctcaaagaaagtacagaaccaagacaagaataggagtccaggagtctttcagcttcagagtctaagtcattttgactatattgttttgcagaaggtgattcatttcaaaataattattttttaacatgagtaatactgaagaattctatggaaaaaaatctcataactaatgtgcaactgggaaaaaaatctgaagaatcataacgtgaacctcacatttatgcatctatctggtaccacaaaggcagaccaagtttcttgaggaaatggaaccactatattctgcaaagttaatttctctctaatttgttgaggacctatgtgctatgcattttatagacattcccactttagaggggaataaaccttaacagttaagagctcgcattctgaggccagatgcccaagttcacataatggctctacctcttaattaactatgtgaccctgaatgaattacttgatctttctggacgtaagtttcctcgtaatttaaatggtagtatctacgagcattatcatggtgagagtattattcttcttcacattaccaattgtgagaaaattaaatgtgttaatatatataaagtgcttagaacattgcctggcacatactaagcactatgaaagtgttagctactactattattgttgtaattgttactatcaccctcacaagtgtatgagttagcactataaaccttcattctgctgatgctcagagaaattacataagtcatacatctaataagagatttgaactcagctactaaacttgagcttttaataactattaagaggaggatctgaaagtagccctctatatttgatctgcctttctgtgccaagtttaacaaatagcagctacactgatgagacaggactaaaggaagccatgccagaacctccaagttaatggtggaatcaactatattaagcattcttcttttttcctcactccaatgacaccttaatttatctgacctcatctgcatcactatctaatttaggatatgtaaaaggcatacaaaatttagagcacataaaagggcctctacgttggaaaagtatacactaataacgactttttggtatagttcctgcgcaagggaaatccttgtaccatatgggtcaccaaatcatagctcgtaagtcaaatcgagtccaccacctgtttatgtctctcaagcttagaatattttacatttttaaatggctggaaaaagtttgaaaaataataatagtttgtaacgtgaaaattataagaaattcaagttccagtatccatcaagtgtactggaacatacccaagttcattgatttataaatatactatatatgataatgctttggctctgtgtccccacccaaatctcatcttgaattgtactcccataattctcatgtgttgtaggagtgaccccctgggagataatctgaatcatgggggcagtttcccacatgctgttcttgtggtagtaagtctcacgagatctgatggttttatcaggggtttccgcttttgcatccttctcattttctcttgtcactgccatgcaagaagtgtctttcacctttcgccatgattctgaagccttcccagccatgtggaagtgtaagtccaattaaacttcttttttttttcccagtctcaggtacgtctttatcagcagcgtgaaaaaggactaatacaatatactatatagtttatggctgtttttcatactacaatggcagagttgagtactttaggcctgcaaaacctaaaacaaataccacctgccctttacagaaaatgtttgccaacccttagtttaggatctattatttatctctgccctccagtgaccctgccatctaatcatttggcctcttaactctctctttaccctgagcaaatccgtaaaataaaaggtatacctttccccaagtactattaaagaaaagaagaggagaggggaaaagggaaaaaggggaaaagaaagtgaggaaagggagaggatgcaaaagaaaaagaaggaaagaaaggaatttccctgatgagatcccttagtaataccttatcagctgttcataatcaaaattcctagaagaggaacaacagcttacttgctataatttcttcacattccattgacttttcttattactcaaaaaacaaagtatgttataatgtgttgatttttaaaataaaacaaacttttcttatttagtcagcaatgaaggtcaagtgagaccttctagtaaaagtcctctaaagtcagacacatgaaaatacttatccatttaaaacagacaatactttccaattatttatttctatgattgaattaatgggacagtgctacaaacagaagtcctatggaataagtcatacttggaagatcagagtttactctagacaacttgacagcaatcagtttaaaaatggtttcacctagagggatgtgtactaatgttagcaattaactttgaaaggcataaaaattaagatggattgatggatacaaggatggttatacgataaagcaatgtaagtattaatggcagaatctaggtggcaggcatatgtgtgtcagctgtaaaatttgtgttcaatgtttttttagttcccacatatcagtgagaacatgtgatatctgtctttccgtgtctggcttagttcactaaaaaaatgaatttacaagacaactggaatataagcaatgaatacaagcactaagaagatgaagccatagaaacagctgccagaaagtgaagatgtgacagtgaacgccaaacaagtaagattagaattacaattagaatcagaaatgacaaaaaagaaacatgaactgtgagatgcaatataaaaactaatggtgaacaaagcaaagaataaaaaataaaaacggaaagattaaaaggaaaatgtgactgtaagtagagtgacctttatattatacagaaggtaaagcagaatgaacatgtgaggaatctaaaaaacagatataaaatagaaacaactgaaggcttatataattagtctataaagctaggaaccactgcttagtaatttctcgtaagtggagtctctttgttctgagacgttgcaaaactccattccatctcaaagttatttttaatgttaaaatttgtaagagtgagcaacggtatcctaaatagttctaggccttgtagaaatagactgtaagagacatctgtgacacaactatattcagtatgatgtagggtctgttacaatgggatgaagtgaatttagattatttcaagactaaacctacaattgtgaactcattagtaccatgaaccgaacaaaaacctattaaatatagaacaagacgattttcatgaaaaaataaatatgaacaaatcagtattttcagttgtttgaaatataggttaaccttcaattactgttttatggccgggtgcagtggctcacgccacgcctctaatcccagcactttgggaggccgaggcaggcggatcatgaggtcaggagatcgagaccatcctggctaacatggtgaaactacgtccctactaaaaatacaaaaaaaaattagctgggcgccgtggtgggcgcctatagtcccagctacttgggaggctgatgcagaagaatggcatgaacccgggaggcggagcttgcagtgagccgagacagagccactgcactgtggcctgggcaaaagagcgagactctgtctcaaaaaaaaaaaagaaaagaaaagaactgtttttttcatttttatagtctcaatatccagaatgcgtgatatatgataaaaaaaaaagtaaaattgtagaactaaatatttacataattcatctgtaaaatgaaaatctgttttacagtgtcatatttcacagttagaaaggaagaaaaaccttaaatcaacaaattaactttacatcttatggaattaggaaatgaagaacaaatgagactcaaacttaccaaaaaataaaaaaaataaaaataaattacagctaaaataaaatagagaaaaatagaaaatttttgcaatagaaaaaaaatcaacaaaattaggagtagctgttttattgaaaagatcaacaaaactggcaaattcttagattaagaaatgaagagaatagacacaaacagcaacaactggaaattagaaaggcgatacaacaactgctgccacagaaataaataggaccttaaaagactaatatgaacaactatgacccaaaaaaatttgataacctttgagaacggatagacacatcaaacccaccaagactgagccacaaatacatacaacttctgaatggacctataactattagagattgaatcagtaactgtccaacaacgccagggcttcactgaaaactctaccaaacatttaaaaactaacaacccttctcaaactctttgaaaaaactagaggacagaacactttcaaaatcattttatgaggtaagcattacttagatatcgaaatcagacaaatttacaagaaaaaagaatccctaataaatactgatgcaaaaaaaatcaacaaaataccaagaaacagaattcaacaatgcattaaaaagattatatttcataaattctcaactggaatttattcataaaatccaaggatggttcaacatacaaaaaaatcactttaatacactgcattcttaggacaaaaaccaataatctcaactgactcagaagaagcatttgacaaaaatcaacacccttttaggatttaaaaaaaggccagacagggtggctcatgcctgtaatcccagcactttagaagggcaaggtgggtggatcacctgaggtcaggagtgtgagaccagcctggccaacacagtgaaaccctgtctctactaaaaatacaaaaactaatcgggcatggtggtgggcgcctgtaattccagctactcgggaggctgaggcaggacaatcacttgagaacccgggaggcggagctggcagtgaggtgagatagcatcattgcactccagcctgggtgacaagagcaagattctgtctcaaaaaaacaaaaacaaaaacgctcaattcgctagaaagatatggaaattacttcaacataatgaaggccatatatagaaagaccacagctaatgttattcaatgatgaaaaactgaaagttttccctctaagatcacaaatggaacaagaatgcacacattcaccacttctattcaacatactgttagacatcctgccagagttagcaactgggcaagaaaaagaaatgaaaggtattaaatgagaaaagtaagaagtaaaattacttctgttagcaaatgacatgatcttttatgttgaaaactctagcctaccaaaaagaaaaaaaaccgttagaataaaggaattcagtaaagttacaggatataaaaaccaatattaagaaaagagttgcatttctaaatactaaaaatgaagaatccaaaaaggaaattaattttttaaacccatttaaaatgaaatcaaagagtaaaaaatacttagggaatattttcaccaagcaaatgaaagacatgtacattgaaaattaaacaacataggccggacgtggtggctcacgcctgtaaccccagcagtttgggaggccaaggtgggctgatcacgaggtcaagagattgagaccatcctggccaacatggtgaaaccctgtctctactaaaaatacaaaataaattagctgggcttggtggcgcgcgcctgtaatcccagccactcgggaggctgaggcaggagttgtcacttgaatttgggaggcagaggtgcagtgagccaagatcacgccactctactccagcctggtgacagagtgagactctgtctcaaaaaaaaaaaaaaaagaaaaagaaaattatacaacaatgctgaaagaaattaaagacaatacaaataaatggaaagacatccaagtttatgaattggaagatttagtactgttaagatggcaatactacccaaagcaatctgcaaattcaaagcaatccctatcaaaatcccaatggcattttctacagaaacagaaaaaaaaaatcttaaaattaatacagaatcttgaaggaccctgaatagccgtaacaatctggacaaaaaacaaagctagaggcctcacattccctgatttctaaagatattgcaaagctatagtaatcaaaacactatggtgctggcataaagacagatatacagaccaagtgagcagaagagagaacacagaaatagggaaaagaggttcttcaacaaactgtattgggaaatctggaatctaacatgcaaaagaatgaagttggagccttatctcacaccatatacaaagatgaactcaagctggattacagacctaaacttaaaacatcgaattataaaactactacaagaaaacatggagaaaaagcttcatgacattggacttggcaatgatttcttgaatagatcaccaaaagcacaagcaaccaaagcaaaaatagacaaactggggatacataaactcaaaaatttctacaaagcaaacagtaaatggagtaaaatggcaacctacaaaacaggagaaaatatttctataccatgtatctgttatttggttaatatccagaatatataaataactcctacaattcaacaacaaaaaatctagttaaaaagtggacaaaggacttgaatagtcatttttccaaagaatatatacaaatgggcaataagcccatgaaaagattctcaccatcactgatcagtagggagaaatgtcaattaaaactgcaatgatacatcatctgaaaccattaggatggccaccattaaaaaaacagaaaataagtattggtgaagatatggagaaactggaacccttatgcaccactggtgaaaatgtaaaatggtgccaggcactgtggaaaacaacatgaaggtccctcaaaaaatttgaaatagaattacctccagttccacatatgaagagcttggaagtcaccactccatcctaacaacaagtaaaaaatgacaaacttaaaaataaacaaatctgagataggataagtgaggtcacagggcaaatgactgcctgtgagagcagagaacaggtgaacacatagcatcaccatttatctgagatgaaaaacacaagcagaaacctccacggggtaggaaatcctgaagtgtaatagacaaattgatgaaggctcagtgtggacaactctgaaagctaaaaactccagagttacccaattatagggggagccctacaattttctaagttttacatccaggcaattgaccagcttctcacagtaaatataggagaaaaatcctcaaccctcagcaggggaggcaaagagaaatgattttcaagtacactagactattccagtcttaacaaggtttgtcctcaggagaaactagttaaccagagcctaacctgctggggttgtagcaaagccaaaatgatgtgggggaagagaaataacccaacttcaggccattatagctatcttgttctaactaagggaatgagggaggggtgggattgagaaacacttgtgaagttcacagtccagaggcataagctcactaaaaagactgacctaatcataagactacagaactcttctcctctccctacaccttacaaccacattactaaatgctcatttacaacagttccttttacctagtacatcatgtccaagctatcaagaaaaaaattacagggcataataaaaggtaaaaaacaagcaccaggaccagatacagcagggatttggaattatcaaacttggaatctaaaacaactatgattaatatgctaagggccctaacgaactgagtaaacaacatgttaaaaaagtagagatgaaaatcctaagaaccaaaaggaagtgctagagataaaacacaaacaaaaacaaaaaacagaacactgtaagagaaatgaagaatgcctttgatgggcttattagtaggctgggcatggatgaagaatctctgagcttgaaaatatgccaaaaaactacatctgggcataaaacgttgtaattacagaaattcaaggataagaaaaaaatccgaagtaagccagagggaaaaaatcaccttacctgtagaggaaaaaaagaaaaaaaagaaaaaatacatgtgacttccaacaagaaaaagagtgaaatattcatagtgttgagagaaaaaaaaaccataaacctagcactctaccttgtgagattattattcaaaagttaaaaagaaacactttctcagacaaaaattaaggaaatttgttgtcagtacacctgccttgcaataagtgttgggaagttcagaaactgaaatctacatatatagagcatcaaaagaaggaaacactgaaagtaaaataaaaccttttatttttcttatacttaattgatctaacaaataagaatttgttcaaaataatgtcaacaattgtgcttatgcatacaaatgctcctaaacttacttattgggttgtgtcccaataccattataaattgaaaatatcatgaaaacacaacttatccaaatttgtgggatacagtgaaagcagcgcttagaaagaaacatacaacactgatgcatttattagaaaagaattatctaggccgggcgctgtggctcacgcctgtaatcccagcactttgggaggctgaggcgggtggatcacatggtcaggagatcaagaccatcctggctaacacagtgaaaccccgtctctactaaaaatacaaaaaaattagccacacgtggtggcaggcgcctgtagtcccagctacttgggaggctgaggcaagagaatggcgtgaacccgggaggcggagcttgcggtgagccgagatcgagccactgcactccagcctgggcgacaaagcgagactccatctcaaaaaaaaaagaaaagaaaagaatgatctaaaaatcaattatctgagctaccaacttatgaaactagaaaaagcaaattaaatccaaatagaagtaataaaaattagagcagaaatcaatgaaattgaaaacaagatatcaatagagaaaaatcaaagaaatcaactagttctctgaaaagatcaataaaatcaataagcctctagccaggctaagaaaaagagacaaaggacaaaataactaatatcagaatgaaaagagtggacatcattacagatctcatggacattaaaaggataatcaagggatattatgaacaactttacggccacgaatttggtaacctagatgaaatgaatcaattccttaaaagacacaatctattagaactctaagaagaaataatcttgattaaaaagcatatattaaagaaattaaatccataattaataatgttctaaaagagaaggcatcaggcccagatggattctctgatgaattctactaaacatttaaggaagaaaccacaccagttctctacaatctccttcagaagacagaagcaaaggagatgctcctatctcattgtatgaagtcagcattactctaatacccaaaccagacaaagacattatcagaaaagaaaactacagacccatatttgtcatgaacaaagatgcaaaaatctttgtattagcaaagtattagcaaactaaattttactacaatgtataaaaagaagtatacaccagcacaaagtaggatttatcccaggtatgcaagactggttcaatattggaaaatcaattaatgcaattcaccatatcaacagactaaagaagaaaaatcacatgaccataccatagatggagagaagtatgtgacaaaatttaacacccactcatgatagaaactagtaaactaggaatagagggaacaccttcaacttgataaagaacgtttacaaaaaacatacagctaacaccatccttaatgatgagaaactagaaactttcttactaagatcaggaacaagaaaagaatatccccacctcaccactccatactggaagtcctagctaagacaagaaaaggaaataaagggtatactaacggggaacaaaaaaatacaactgcctttgtttgcagatgaaatgactatatgtgtagaacatagacaggaattgaaaaaaagaaaaagaaaaacaacaaaaacctcctagaactaataagtgattatagcaaagctgcaggatacaaggttcatataaaaaagttaatagctttcctgtaaaccagcaatgcataagttgaatttgaaattaaaaacacaataccattttacattagcgtgtcccaaaatgaaatatttaagtacagatctaacaaaattagtacaagatatatgaggaaaaatgttttagaactctgatgaaagaaatcaaataactaaataatgaagagctattccatgacccgtgagagacaactcaatattgacagaaaaagtcagatggacactactgatttcaagatttactgtaaagctacagtagtcaagatggtgtggtactgacaaaagaactgacaaaacagaccaacgaaacagaatagagagcccagaaatggacccacatagtcaaaggagcaatggcagtatttgacaaagaggcaaaggcaatacaatgaagaaaatagtctttttcaataaacagtggtaataactgaacatccacatgcaaaaaaaaaaagagtctagacacaggtcttacacccttcacaaaaataaactcaaaataaaccagagaattaaatgtaaaactcaaaactataaaactcctagaggataacataagaaaaaatctagatcttgggtttggtgatgacttttagatacggcaccaaaggtaccaaccatgaagaaaagaactgataagccagacttcattaaaattgtctacttgtttcttaaaaattgttgtcttttgcaaaagacaatgtcaagagtatgaaaagacaagccacagatagggaggaaatatttacataagacacatctgataaagaactattaactaaaatgtgtaaggaggctgggtgtggtggctcacatcccagcactttgggaggccaaggtgggtggatcacctgaggtcaggaggtcgagaccagcctggctaacatagtgaaaccccgtgtctactaaaaatacaaaaattagccaggtgtggtggtgcacgggtataatcccagctactcgggaggctgacgcaggagaatcacttgaacccaggtggcagaggttgcagggagccaagactgtgccactgtactgcaacctgggtgacagagcgaggctctgtctcaacagacagacagacagacagacaagacagacagagacagtgtaaggaactcttaaaattccacaagaaaacaaacaacccaattaaaaaattggccaacaaccttaacagacacctcaccaaagatatacagatggcaattcagcatatgaaaagatgtcccacacatcatatggcatcagagaaacacaaattaaaattataagatacctctacacacctatcagaatggacaaaattcagaacactgataacaccaaatactggtgaagatgtagagcaaaagaaacactcactcattgctggtgaaaaatgtaaaaggatagcgtcatattagaagacagtttggatgtttcctacaaaactaaacacttttaccataagatccagcaattgcactccctagtatttacagaaagtcgctgaaaacctaagtccacacaaaaacctgcacaccgatatctacagcagttttattcataattagcaaaatgtggaagcaaccacaatgtccttcattaggtgaatattcattcacaaactgtgatatgtccagaaaatggaaaaagagaggtactaacaacctatgaaaagacatggaagaaactttaatgcatattagtaagtaaaaatagtcaagctgaaagggctatatactgtatgattacaagtatataatatgctggaaaaggcaaagttagagacacagtaaaaggatcggtgattgccaaggagtgggagggaaggaaagataaataggcagaacacagaggattttggggcagtgaaaacattctgtatgatataatggtagatacatgtcattgtactttgttcaaagccacagaacgtacagcactaagaatgatccctaatataaactacggactttgggtaattatgatgtatcaatataggttcatcagaaagacatgtaccactctggtgggagatgcacactggctatgagagaatccatacatgtgtgtggaaggaggtacaggggaaatctctgtaccttcctctcaattctgtgaacctagaactcctgtaaaaaaaaaaaaaatctaaaaaaaaatagaatacatatgatccagtaatcctacacctgggtatacttccaaatatattaaaaacaggttctcaaaaaaatatttgtatacccatgtttatttcaacattacaatattcaagaagtggaaggaacctaaacatccatcaacaaatggttaaagaaaatgtggtatacatatataacaaaatgttattcagcctaaaagaaaagaaagaaattctgtaatatgctacaacacaaatgaaccttgaggacattgctatgtgaaataggccagtcaacaaaagacaaatacttaatgattccactgacatgaagtagccaaaacagtcaaattttagaggcaaaaagtagaatggcatttgccaaggaataggaagaagggggaaaagaagagttgttcaatgaatgtagagtttctgttttacaagatgaaaaagttctagagatctgctgcacaacaatgtgcacagttaccacaattgtaccgtacacttcaaatcattaatatggtaaaatgtgttgtttttgacaatttttaaaactctaccccattgttttctttacctcttatataaactgataaaaacctgttttatcttaatcaattattgtatgactactgctccccagagaaaaaagtgcatgtgaaatactactacttatccatctcctggctctgagcagtacatgtcaggaacaagagggaattgtagctggaagacagtagaagagccataggacaagtctctaagagaaggaagaaaaggcgcaatgaaagaaaacaagtttaagatagtagaaaagcattcaaagacggcaacctgaggtaaggtgttttcactgaagcttttggggtaaaacagttttgagttggcatgcctgtagacatgggaagcagcagtgatgcagaggtgaacattactgtagataaaaacggatgggaatttgacttgctagggactgaggggttaatcatataaataaagatggcagcagatttgggaaagagtgaagaagaataagttcaggtagcagtcctcaaaaaccgagaagaaactgatagctcactgaaggcagacagaggaagacaaaaccagaaggcataagcttcaaaggagcagggatttttatgctgagagagtaaaaggaatagttcaaagcagcagtggagaacacgaataacgttccatgtgggaaaagaacatgtccagagcttactgtacctataacctagcttctgtaactggaaatgaagaatctgctctagtcaggtcatcacttttcactacttattttacttggccttcctaagaaatatagaccttttggaaattattgacttttgggtctaggacactatttcttggtttcctcccttctctctggctgtttttcagagacttcccttccaaatctagagacatttgtattctccagggatcagctattagatactttcccttttaaatttccctttggacagtttcatctttcaaggattgagcaataactaaatgacttccaaatgtctacttcagtataaattctgcttgtcaggctacataaaaagggctcttcaaggaattatgatgtctaaagaaagagaaagccacgatttcaatatcacagagatgactacagaggaatagcaataaaaagagaggcaacttaggagaggtgaatcacaaaagatgactaggagctgatgacactatgggtgggaagaatgtttcagacaggggaagaatgtttcagatagaggaaaatgagtaaaagcacaggggcctgaaaacatgatattataagacaattccaagcacttcaagagcctaaagttcaagaaaagtttcaaaaatatgaaaatggagaggcagggaaaagccagatcatggaagacctcaatagccatgataagtaattctttttttagccaaaagaggagtaatctaataaaagctaaagatcttctcctcataaaaatacatgcacacttcaggagtgcaaatgcactcttccggaagattcgtaacccactacattcataaaccattagataagaactaaaacacaaggagtcactgaagggttttaagcaggttaagtgactgacaaaatttgccttttcaataactgaaaccaaagtgggcaaaactggaggcaagcaatccagttaggtaatgactactgtaatagtccggacaaataatgtagcagtaggaagaaaaaaaaagatgaaattgacccaggaaatatttaaaataagtagtttgtaagaggtaaataagctggaagagccagaggtaatgggtagggtttctggtatgggcaacaagatatgctacaagctgagatgttagtaaaaacaagcgttcatcagcatttagtaagtgatttatttatattatatcactgaatactcaattatgttaagaggcagacagcagttaaaaaacaaagaactcggtgaatcaaaaagttctgctaatttggggaaatagcatcccttttatttttgttaatctcttttgggtttgatcctcatttatagctgacaagaagttctatgtactaaaggtaaactattctcattaatgttcccaaaaatctcttggaataattaagatataaagaaattcaaaattcacatgattataaaaatctttccttagataatctcataatatagccatgttttgctcattctactttgagaagattcagccagaaacagttcatccattcaactatccctactgtgaactagaagtatgtttccttacatttgaaacagaagatataggtttatatgatgcttcaggtggtagaaaagcagggcagactatgactcgtgtcacttccttccacacgtgatgcctttcatgggctcctgtgtctgtcagaagaaagcaaagggccttagcgtgctcctggctttctatatccaaatgcattttttcacaccttctcccatcagctaactctacattactgcaatacggaacttcttactactcagtggacttgttctgctgtcttctctgattccaggtgttattcttcctgcctagaacactatgattcttagctattcccaagcatcctcaaggtttcagcttatataccacttttaagataattaggtattcttcctctgtagtctcataccaaccagtacctattctattatatataataactgcctattaattaaatgggaagctgaggtatatgacctaataacttatttactgtcgtatcctcagaacctagcaaattacagagtctcaacagagatttttcaatttctcttctgatactgtctcgataacagtgtcaattaaacctttctctaattatttgaccttgaagggaaatagatgtcagactacctcctggtttcgagtatactggaagcatacaaaaggaccttctcaatctggagaccaagaatatgatatgagaacctataggagaaccacttatttgattaaagagatttcttttacttcagaaaatatttcagtatgttacttgacccataaatgcttatagatgtgtaagtacaccgaagaagtcatataggaaataaaagcatccaagctatatttctatggtctactctgattaaaaagctcagctctcctatcaaattcaagataatgcatgtggattatggagcacagtcacttgctacatggtaaatgctcaaaaagatgataggtggtattacccacattctacaggctgtgtacatacttatcagtttatatatatacataaactgatcctaaaaaattcttcctacatttctgcaagataattaaaaaggcagaaacaaacattttgcataaatttactagcttcattctttcatgtaggaagtagttactgactacctactgtatgccaggcactgtcattaggcttccattctagtggtaaagaagcaaaacaacaaagaaatcaatatgcaagaagtcaaatgacattaaatcccatgaagaaaaatgcagcaagttaaggggaatgcagaagaacatgatcattctttgatgcagccggtcaggaaaagcatcatttgagcagagagctctctgaatcaagtgaggaaggaagccacatggattatcacagagaagggtcacagggtcacagacaatagttacaagccttaagatgacaaagatacagccattttagacagagatgagcaagtgcggtagagagatcacagaaatgaaaggaagccagttcacacagggccatgtaaatctccagattttacttttaagatgggaagcctctgaaaagttctgtgcatagtaaataacatggtttaactcagattttaaaaagatcattccggctgctactagagaatacactgtaaagcacaagactcctgggaaacaatttctttcttttgccaaaagatgatgcctttaaacagagtaaacagaagtataatggttaaaaaaaataaaatgaattatgggtatttggaaggtgtagccaacaagatttaccaataatttgagtatgtgacatagagaaattaaaagatgcttccaaggcttctggctgcacaggaggggaaaaaagctgttattgactgagatggcaaaatattatgagagacgtaggtttgggatgatgaaaatcaggagctccacttaggacaggttaagtttgagaaccagacttaactgttggataaatcagtctacagttcagagggcaagagctgacgatggaaatagaagagttgtcaatagacagagtcctggggcatttctgacatttacagtaaactgagcatttattaaaactaacttgctttactgaaccataaatcacttgttgtatttacccctgctccatttatagttatacatctggaaacatagccttagtgttagaggtaaagagtaaataccaaacataaaaaatctgatctggttgggtgcggtggctcaagcctgtaatcccagcgctctggaaggccgaggcaggcagatcacgaggtcaggagttcaagaccagcctggccaatatggtgaaactctgtctctactaaaaatacaaaattagccaggcatggtggcacatgcctgtaatctcagctactcgggtggctgaggcaggagaattgcttcatcctgggaggcaggggttgcagtgagccaaattgcgccactgcactccagcctgggtgacagagcaagattccatctcaaaaaaaaaatctgaagttactgagaaactggtatgaaatcattaagaaaactaaggtgtctaaattaatacatacaaagagattctacaacacggtatttataaatttaaacaaaatccatggccaggcacggtggctcacgtctgtagtcccagcactttgtgaggccaaggcagaaggattactttggggccaagagttcaagaccagcctgggcaacatagtgagaccctgtctctacaaaaaacaaacaaacaaacaaaaacactgttttagcctggcatggtggcacatgcctgtagtcccagctactcaggaggctgaggcatgaggatcacttgagcccaggaattcaaagttgtagtgagctctgatcacaccactgcactctagctgtatcacttatgacagagcaagacaatatctcaaacaacaagcaaacaaaacaaaaaactaaagtaaatccaggtaaaataaacatacgaataaatgaaaagatctgggttattgcattagttctgtttctaggcttaactacaaaatggtgtccagttgttaaaaacacttgtttaagagtattaataatttttttttttactatgctcttctacatcctaggaaattggcaacactaagaattcctaaaaacaaacaggagtgttaactgtatataaattattatttaagatgcattcaaggcgttacttaaaatatcaaatgcatgtcaaagtacaaacaacaaaatcatgcttcaacaaatgtgggatgttgccattaatggacagttagctctgaggtaaaaccaagaatccttcattacctatttttgtaaattaggacaaatactattaaggtattaggttggtacaaaagtaattgaacaaacctggacccactcacctcactgaaagtgctgcctggctacagtttctagatataggaatgtgagaaatggtagcagccttgaaggtttagagctatattcccataccaattatggctagaaacttaaaacagctctattgagacattatgggaagtctaatttcctgttactctactttaacacagccaagtaaaacagtaagaaagcttgcttaattcaacaaggactgagtgccagagtgtcacctggaaacttgtgacaaataatcatgcctcacacattcatccttggtttttactaccaaatgcaagcttcatctatcctcttccattctaaacttgactcatcctcctaacctcttccagaaagatctctagaaacccagaggctttctgaagacccataggctatcccccatcttcaactactttacataatggcccctcaacttcttagctttcatgaaagcctggctcctccccaaaggcactgcctatcatgcaacccttttatgtgactcctaaaactcctaagtccaccattattcttctaattccctgtattaaaaataaacggcaaaattccctgtattaaaaacaacaaaaaaacagcttgtaatttgaaactcatgtcatctaaccgaatgccttctctttccctccctgttctggtcaattaaacccacatatttaagcctccactttgcccccagttacatcatcagcaaagtgacttcaatgtccctgtacatggttctatcccaatactctaggcccccaaaatatttgcctttctaaatttgagacatcttcacctcctcatttcagcaaatcactcccttgtctttgttagacatactaaaacctctgacaatgatcatctcagctatctttgtaagagtttcactcatactcatatctcctttcacctgtcaagacaccaggtttggtgacaaataaaaatgatacgtatttgggaggctgaggcaggagaatcatttgaacccaggaagcagaggatgcagtggccaagatcatgctactacactccagcctgggtgacaaagcaagactctgtctcaaaaaaaaaaaaaaaaaaaaaaaacacaaaaaacaaaaaaaaggatacatatttattgtattcacatgatgttccaaaatatgtatacactgtggaatggctagatcaagctaattaatacatgcaatacctcacatacttatattttatggcagaacatttaaaatctactctcagtgatttccaaaaatacactgttattaactagtttccatgttgtacaatagataccttgaacaaattcctcttaattgaaattttgtgtcctctgaccaacacctctgcaacccagtccactcacccccagcccctggtaaccaccattttacatccctgagttaagattccacatttaagagagatgtagtatttgcctttctgtggctggcttactttcaacaatgccctccaggttcatccctgctgtcacaaatgacagcatttcctcctttttatggctgaagtatattccactgtgtatacataccacattttctttatccatgaacacttaggctgatgctgtatcatgggtattgcaaatgataccgaaaggaacatgggagtacagatctcttcagcgcactgattttattcttttatttatatatatatatatatatatatatatatatatatatatatataaaaatacatatatatccaagtgtgactgctgaatcatatggtagttctattttttaatttctgagcaaacgtcatgctattttccataaatgctgtactaatttacattcctgccatgcgcaatatatctcttgtctgcaaatcctcatcatactttaatagccattctaatggccatttgtatgtcttattttgagaaatgtctattcaagtcctttgcccatttcttaagtgaggtgctttcttactattgagatgtctgagttccttatatattttgcatattaaccccttaccagatatatggtttggaaatactatcttccattctgtgagttttttcattctgtagattttttctttttgccatgcagaagctttttagtttgatgtgatctcattcatcaatttttatttttgttgcctgtgcttcgagggggtcatatccaaaaaaatcactgtccaaaccaatgtcatgtacatttctcctatactttattctggtagttctacagtttcaggtcttatatttaagaccttaatccattttaacttgaatttggtatatgatgtgagatacaggtctgatttcattctcatgcatgtagatattccattttcccaacaccacctattgaacagacttccctttccccgctgtgttctttgcaccctgtccaaaatcaactgatagtacacgaatttatttctgtgctctccattctgttttgtgggtcgatgtgtctgtttttttgtttcttttgtttttaaaagacagggtctcacgctgtcatccaggctggagtgcagtgatgcaatcacagttcactgccaccttaagctcctgagctcaagcaatcctccttcttcagcctctcgggtagctaggactacagatacacagcaccgcgcctggctttaaaaattttttttttttttaattttagagacagggtctcactatgttgcccaggctgctctcgaactcctggtttcaagtaatccttctgcctcagtctcccagagtgtgggaatacacgtgtgagcaactgtgcctggcctgtctacttctatgtgactatcatgctgttataattactgtagctttgaactatattttgaaatcagatagtgtgatgtctccagctttgttcttttcactcatgacagctttggctatttaggatcttatgtggttccatataaattttagcactgttttctagttctgtgaaatttaacattggaattttgatcaggattgcattaaaactgcagattgctttggataataaaaacattttacaatattaattcttccaatccataaacacaagataactttccattatttgtatcatcttcaatttctttaatcaatgttacatagttttcaactctttggttaaagttatttctaagtacaatcatccctcggtatctgcaggatattggttccaggatctcctgtagataccaaaatccatggatgctcaagtccattatataaaatggtatagtatttgcatacaacctacacacatcctcgtgtatactttaaatcattacttagtacctaatacaacgtaaatgctatgtaaatagttgctatactgtagtttccttattgtataagaaaacagtatttttattgttgtatttttttctcaaatattttcatccaaatgttggttcaatttgcaaatgcagaaccactgatactgggagccactgcatgttttgtttttggtacctattatacatggaattgtcttcttgatttttcttttagataatttgtcattaatgtacagaaattctacggatttttgtatcttgattttatatcttacaactttactgaatttatcagttctaacaattctctggtggagtctttaggtttttctatatacaagatcatgtcatcttcaaacagggacaacaatgtcttcctttcctactgggatgccttttctttctcttgcctaattgctcttgcaaggacttccggtactgtgctgaatagaaatggcaaaagtgggcattctcgttttcttcctgatctcaaaagaaaagcttttaacttttcaacattcagtataacgttagcagtgtgtttgtcaatatggcctttattttatagaggtacattccttctatacttaattttttaaaattttgtagcacaagagaatactgaattctgtcaaatgctttttctcaattatctcaattatctattgaaatgataacatggttttggcctttgttctcctaatgttgtatatcacattttatggattcaggtctgttggataatccttgtacccttgaggtaaatcccatatgatcacagtaaatgatccttctaatacactgttgaatttagttattattttcttcagaatttctgcatctaaattaagaatacgggtctgtaattttcttttcctggagagttcttgtctggctttggtatctaggtaatgctcatctcccaaaatgagtttgaaattactccctcttcttaaatttctcataaaattatgagaacaatctgtactagttcttctttaaatgtctgctagaattcagcagtaaagtcaccaagtcttgggcttcctttggtgggagatatttttatgactgatacaatccttgtcactggactgttcacatttttcatttcatgattaagcttggacaagttgcatgtgtctaggaatttatccatttcttctatggtaatcaatttgttggcatataattgttcagtctcttatgatcctcttatttcttgtacttctctggtatcagctgcaatggttcctctttcatttctgatttaacttgagtcatctctttttttcttagtctagctaaagacttgttgcttttatcatcaaaaaacacaactctttattttttttatcttgagtcatctcttttttccttagtctagccaaataacctgtcttttgagttcagattcttttgtctgcttgctcaattctgcttttaatgctcttttgcatttttcattccatttattgcattttcagcttcagaatttgttaaaaaataatttcaatctcaaaatttctcattttgattgctgttttcctgattttgttgaattgtttatctgcattttcttgaaattcattgagcttccttaaacaattactttgaattctttgtcaggcagttcatatatctccatttctttatggttggttcaggtgccttattgtgttcctttgactggtgtcacgtttccctgactgttcttgatccctgtagtcatgtgttggcacctgcacatttgaagaagctgagacttgttccagtctttgcagagtgactttattgggtaaagcccttcaccagtcagcctgtccagagattatgcagcctgagtctaccggggctggcctggagtctgggtcagcagggtaggtcctggagccttggtacacaggtgctgctggcctggcatcctggtctactagagtgagcctgaaccttggatctgcaaggaccagtgtgaaggctgggtaggtggatgttggcctagaatttggatcacaaggggctggccaagtactgggtttggacccttgttctgcagtgatgtgaggccacaggggccgatctagagggcagggctgcagggaccaccctagcactagacaggcttagagcctagggctgtgggatccagcttggtgctggggtgggcctccaagcttggtttgtgggtattggcctgaagtttggggccatgggggcctgcctagcattgagttttactggggcgagctcaatgttagggtctaagtctggtgtacacttcccctccttcccccaggtgaacagtctctctctccatgctgggatctcagggactgagggaggtgtgacacaagtaatgtaaaactgtccttcttacccttttcaatgtgtcttttcttatctgtgtgccacattcaggtaatctctcgtctggtttcttagctcttatatttttgtgtgtagacagttgttcaaattgatggttctacaatgagatgagtgctgcaaagtgctagtctgccatcttgctgttatctagacctcaggcttttcttaaaacaactcaacactttggtctggcatcccaacctttccaatcatggccatcatccacagcatataaattcaaatactccaatgttaacatcttatgcacatgccactaatgattctgttccatcagctctgctaatatccaaccctaaaataccatgcataatcttctggctattggagaaaagtctttaaatttcaaatgtgataaagtctttaatcttaactagtcactcagtggaatgagattctcctactctgatacggtttctgatttcaggtagccagccagtcaagactctcaacttctgatccacttcttcacccattcccctcagtagcttcctaagttttcagtcttctcaaaacctctaaacaaaccttgtattccacaaaatattattaaaaaatgtttcataaaaagtttcgtggtcactaacctacagtaacatactaccttatatccactacaatgactactattgaagtacacacacacacacactctcacacaatatgtgatggcaaggatgtagagaaactggaccccttgtgcactagtggtagaaacgcaaataggtacagttgctctggaagagtatggcagtttctcaaaattttaaaaataaaattaccatatgatccaacaattccacttctgggaaaacaattcaaagcagggtctcaaaaagatatttgtacactcctgttcatagcaacattatctgtaatagctacaacatggaagcaacctgagcgctcatcaacaggtaaatggataagcaaaatgtggtatatacatacaataaaacattattcagcctgaaaaaggatgcaaattttgaaacatgctaaagatggatgaaacttgatgacactgcgaagtaaaataagccaatcataaaagggcaaaaactgtatgattgcacttatagggggtacttagagcagtcaaaattagacacaaagtagaataatggttgtcagaggctgtgaagataaggaaatgaggaattattgtttaatgggtacagagtttcagttctgcaaaacagagagttctgatcgtgactgtgcaacaatattaatatacttaataccattgagccaaatacttaaaaatggtgaaatggaaaattttacattatgtgtattttactacaattttttaaagcttaaaagacaagtcacatggttgggtcacataaatttgagaaatacattttatagtcgtttcttgcagattcacaatatataccggcatttaaataaggttccaatattttcagtaaaaaaatcttgatttttccaccctcacccacaattacaattaatatcacacatccatctttacttccttgttctaatttcattagatgggcatctttcctcttattcaaggtcaatcactatatctgcatttttctttttttatattacctgtatgagagatacacctgtatttttcattccaacccttaatacctcgaaaaactttgctttgataattactacctctattatctgaaacatctttagtcttcacaataaatcactaaagtcttacttacttcatgtcctaaatatttgtcttaaatccagaaaaatttattttgaattcctattataccactgtcattgtcaaggctctcactgactgaactaccttaccaccacacgtttctcttcaatcctttctctcttgcaaggttattaaaaatacacgtttgacaaacttactatctacctactgagcaaattctttgctgactccctaataccttctatcacatcttatcttcttcattttcctacctctcagctagtttatgatctaaaagtcctcaactgcctattgtcccctactccctatgctgcttctaactttggctcatacttctgcctggaataagccgctcatgcttctagctgcctgattcccagtcacatttcaagactgaacttagcatttcctggccactcttacttccctgccatctacactagattcctattgcatacctgggtactccagtactccttcatgttactattgtattttggataccattctacctcagtgactgaaattatttgcttctgcatctttcactcttgagtataatataaatttctgtagggtgaaaactaattattacgcatctctgtatctataacatagtacttgatgccttaaatatggtaggcgttgagactgttaaactcaactctttcctcaacctccctatttccctacaactgctaccagggaagcaaaaagactaagaatttaggcgtgtgcatttatctatctagtagtagaaacctagtaaactgttaccgaggtttagagttatctgataggaaaaaaagtaggtatgttcctatctcccatttactgctaaatgattcctttcttttaaccagaaattatttccaaataatgtgacgtaatttaaagcagtctagggcaactcaaaataagaaccacagtctcaaccaagttacacttacattcggctagcttcaatgtcgtcagactgaggttctcctgatctgtaaaatgcaattgagaaacagttagcaaaatattccatattccaaaaaaaaaggtagacatattacttaggaagacaattttgtaaacaagatttaagcactaaataaaacagttttaaaattaaagatgtcaacatgaaagaaagtggtcagatcaggtggccatacaacacatttattttaagggttggactattaaaaaactcaatgcatgttttttaaaggaaactgtaaacgctatacatagataccaacagacaagccattataagccataattattcacaaagtcaaatacgtgtaataaaacacacaactaaaaaacttcctatagccaagtattggttatccacattaacaaaggtactcactggtattcactcacagtattaaactttagattagtggctcagtaaactactccctaggcagacagactaaagcttaggccagccatgtagttttgtaaatgaagttttattgggatgcagccatactcattcatttaggtatcatctatggctgctttcacactaaaagaacagagctgaggacttgtggcagaaaccacatggcccataaagcctaaaatatttattttctggccctttaagaacaaatgtgccaaccgctaccgctactccagacaattcaaactaaaatctaataccttggtaagtttaaagacacttaaatcagatacaacattctaatgatgattatcttggttcaacaatgaaactgtttccctaaaaatacacttactgtatgtattacctgtcaaaagtgtatcacctgaggtgaagttttgcactggatagctgtgaattaacttcagttttaaacagttgccagttactttgttatttctaaatatactactgctctctcatgtagaaatatttaaaattctaagtcactaaaaagcctttcattttcatttcacgagatatgaatcagtatttccctatctattcacttttataaacagcatcagcaacaatgaatgagtcaatataatattgatttctaacacttagaaattcccaaactagataaaaaatgttttttgaggtcaaaagctaaattttcaaattggcattacaaagtcctgatttgtgaacttctcactgactttaggcttccaactttaagcaactctaacaagaatcttaaaatcagtcacacacacacacacacacacacacacgcacacacacaaacctgttttctaaatttcttagctaaaaacaaaaacaaaaacaaaaaacaacccctcacttctttatcagactctcaaaattaccctcactgcaattcattcagattccaaggacaagaatggaaaaggaaaaaaaaaaaaaaaaaagactccagcagctcaaatatttattttagatcttctttgcaatgtatttaaattttcaattttgcacaaaattacataacaactaaaaactggggcatgctggaggtggcagtgacttggctgtgacacaaatgcaaaaatttcactccaccctctcccccagggagcaagcaaatcacctatgtgacacacctggtctccaccagccttgtgggtaagtaccccaagattgcttccaaacttgtatctcccagacagaagagctaaaaattgatgataaccccatgtaccagctgactcatttttgaaagtgcgaccctccagcatcagatgtcatactgtaaggaggcagagctggcttgcaaaacaaaaaataaacctgctggcactgagggaagagaggcagattagaagttttcaaacacgtaggcagcaaaactttcaaaattaacagggaaagagaagagagggaaaaaatgaggacatgatgataggaaaataaaaatattactgcaaaaaggtaagacacaagaagaaaaacaaatctaagtcttagaagtacaatatgtaactgttacaaagttttgagatcctgaaatgggatagagtttaaatacattatcaaatgataactacatctatcttcccaatttctgttccctaagcaagagaatatgtgaactttggcatcaaaatgtttgccaccaaactgtaacatattaattactactttttacatatattaaagtaggctattaaaaaccattgataagacaagctaagtaatttaaaccaatccagtatagaagaagaaggattgaaagattattaccttaaaataaatctgtcctgggtctattaaacatagcaaagttgttctactcaaattggaaattgttttttaatcaagagaaaaatgaatatatgcagaactagcagacatttttcttgcagtaatttataatagtttctgtctgaatgaatttctactcatcctaataacagtatatttctagaatattataaataagttaccaaagtcccgaggttagaattcaaactctcaaaactatgacatatgccaggtgtggtagttcatgtctgtaatctcagcactttgggaggtcaagacataaggaccacttgagctcaggagttcaaggtcaacctgggcaacatgatgaaacctcgtctcttagccgggtgtggtggtgggtgcctttagtcccagcaacttgggaggctgaggtgggagggtcacttgagcccagaaggtcaaagttgcagtgaactgtgatcgtgccactgcactccagcctgggcgatggagtgagaccttgtcttggaaacaaacataaactatgaaatatataccacctagcaacagttcccaagcttgactttggctcctaaagagtctacttattcttttactgccaagttgctggaagtaagaatcctgtatgtgcttgtaaatgcagaacatataacctaattcaaaacatataaccaaagggaaatttttgtattaaactattgacttaggttatcctaaagtgtgtcagaataacaagtcagaaattttaaaactgaaacaataaccaaataacattggataataaaatgtaaatctcagaatgagaatcaattttaggtcttgatttgaatcgcagaaaatatgatcacaaaacacccactaatctgaatactgcagcatgagctagcaaattcaaatggtggctcacttccaataacactggtgcagcttctccatcctgcaagccactccttttacctccactgtaactctctaggagagaaaagtatactagttttattaatgttataaaaacttctagagaaatgtttagttaaaacgttcaccacataaaaggcatactttaaaatgcatattaagaaatttttaatgttttctataatgtttatagtaaaatgtttaaaaccttgaagtttttttgagaaatactttcctgtttatacatacagataggtctttgatagtggctactgatatttttaatgagaaaaaaagacactaaaatattttaaggagattaaatgaagtaggtcaactctcaggcccactattcttagcagtattcctgccaactatacattgtcttcatttttacagtatgtatttcactttacaatgacagccttttaaaggctgtaaaataattcaaaattaccttttacaagctgtggccattcggtgacatcagggtgatcacagctttgagtcactgattaaaaacaggttgtcacaccagtctagctgctaccttgatctgagcgtaggcttaataactctaataaattaaacaaacctttggttagaacactttaatatataaacccaattcattgttcaaaaaataatattcaaagcttcaaattaggtgtcaatgtaaaattcatcagaagagtaattattatagaaaagtttttaaggactattttccagcattttgtttttcttaaatgatctcttcatttgagaaaatgtaataattccttgtacttttatgtaatgttatagtttctgaagcattttggtcaatagtaccttgagtcttataacaactttggctttacctaatcaagacagataatatactaagaattaaaaaaaaaaaaaattaagcagcctccgagtgattaactgacttgcccaagattttggaactagtgttgaaggactgactaaaacccagatatactgacttcctatcaagggatggatttttttgtttgttttggcttagttttgctatactgggtttcaagatttaagtatatgtaaatgagtaaagattcagaacacagattgagatctttcaaatacggacaaattcagtcaaaagattcctaagctgatagagcaatcagtcaccaaggagggcaactgcttaatggaatagttatatacatacacataaacacacacacataaacacaaagtctagtcccactaattctgtatgtacgtaaagtcatttaacatcagtcaccgcatgttctcactcacaggtgggaactgaacaatgagaacacatggacacaggaaggggaacatcacactctggggactgttgtggggtggggggaaggggagggatagcattaggaaatatacctaatgctaaatgacgagttaatgggtgcagcacaccagcatggcacatgtatacatatgtaactaacctgcacattgtgcacatgtaccctaaaacttaaagtataataataataaaaaacatcagtcaaaaccccttaagtactgcataaaaatatattctactctttcttggccataaatctactaagatttaatttcatgaaaaagtatggcaaaagatgaaagcatatcctcctccctcaaccaaatatctttttaaccccttacatggccttagctgaacttttctgattgtcacagttcaaatttagcaggcctctttactgacactgtagttctggcaaagataccatacatctgaaatatcccagtatcaaaagatcattttgtgcaactagttctttcccctcacgattcccctatccaggccaaatctgaggcatcaactacggaaagatgaggaaattaggaggaagaaacctttcataattaacatcctcaaagcaacaatagtcaagcgtaaaaggtggttaccagtgtggattcagaacccaatataaaacagcaaggtatctgcgaataccaacggttaaaacatgaatgtttgagcccatacctatgcagctatgaacgcagggcttcaaaatccagattaggtgaggattggcctgaatatataaaaataattgcaggggattccaataaatgggatttatagtatctgtaagaaataacgcaatctcccagatactcctatcctaactatacattgcctaataagaacttagacattgctgaggtcatatgggaaacaccaccttccctaaaataaacaatgtggtcatgatacagcttccccttgggttctcaagagactaatggtatgtggaattagaagattcaaacaagtctaactttccatcttgtaaacacaaaaataataaagttaaaatatcttttaattgactaattgacctcaatgtaattaaagagctatatgtattttgaaaactagagtcaagtcctctcttccagtcccctcttttatgagatccggtgctcaaaaggctccaaggccaggctggacttatgtctctgtttggtcattcactagctgagaaatcttgggcaagttacttaacctctccgagtctcagtttccttataggtagaactaggataatagtacctattccatagagctgtcatggataaacaagctaacatctaagtatctcagaacagtgcctgacataatgtgctcacaaatggctgggcgtggtggctaacgcctgtaatcccagcactttgggaggccaaggcgggtggatcacttgaggccaggagttcgagactagcctggccaacacggtgaaaccccgtctctactaaaaatacaaaacttagccaggtgtggtggcacacgcctgtaatcccagctacctgggaggccaaggcatgagaatcacttgaacctgggagatggacgttgcagtgagtcaagaaggtgccactgcactccagcctgggcaacagagcaagactctgtctcaaaaacaacagcagcagcagcagcagcaacaacaacaacaaatgaaagctattattaatactcatagcccaaaatccaaacctgccctctcaatctttttatgcatattattttacctctcatagcacactaatctcttgtaaattttttcagcaccctacctgggtccctcatacagtcttggaagtgtagttagtgagcacctgacacaatgctttaaaaatggcaggggcccaaatttgctgaacacatctgtcattattatgacattaagatacacatgcaatacgaattccaaaaaataaaacaaaaacataccatatttcgccaaacttctgaggagctggtgaattctaaaatcaggctcttacagatttttaacctaaaatataaaacacctcactcaattctttttacataaacaactggatgaactttcaaaaaaaaaggtactaaatttcatcataaaggcaaatttattttctataattatgaacatccaaaaacgtatcaagaaacaaattactgctgttgccgggatgaggaaagcataggtaggcaggccctgtggcctgagtgctttcagcaggcaaagccatatttcccatattcatccataaagcttagtgccttctatttatttactctatcctccctccaaaagggctaaacacatatgaaaactatttgactatatccctctaatcctttcaaatacctatagcaattttgtttttaattaaattctatatgctaagcatcggctatgttaggtacaaatctgggcatctaccactttctagagtagcagccttgggccgaccctctgacccttgagtctccaatgtcaggttattgtagcagagaaaatgcgttaaaaagttatagtataatgcctacctggcacaaaacaggacttcaatatacgacgataattataatttattaaatcaaccacttaatatatatcaaaacttaactcttaaaaaaaaatcctgaagcttaaagcaagcccctaaattatcactgtaaattcttaacttgtttgtatacaatcagaacattcctcaatggaacaaaaataaagtcctttcatgtactgcattacatataaagaaagcaaatctcaaaggttaagaaacctatccagtgtcctagaggttgatggtagaaagtgaatacactgcatataaaacattttgaaataaaattaaccaacttttaaggttttagagactgactttcaaacttcagtctataatagaattacctggggaaatctaaaaatgcaactacttgggctctactcgcaaagattttcattcagtgcatgaagtaggggtaaatgaattttttttttaatttttttcagaccaacccaagaacgcagaaatgaatttgcattttaacatatacttcacatgacacacagatctcattttaagaagccctgccttccaaattatgagttaggaacacataatcatggaggaaatataccaaatctataaaaatacagaataacaaaaactgtaagcactacaaatattaggcacactcacttgccaatttaaccataagaatcctaataccagacatagttctcttactttatctcttcaacagagggctcagtctaataatcttataaataagtatagtctaataataaatgcctatgttgatctatatctacctccctaaaattttcattttattcatttctatttttccttcacctccttctaaagctgtttcaaaacttaatttcacaaactgtttttttctatcactttttattataacacccaacacttctgttctcctttgcatcatgtttatggtgtcttatatttatggataatgctacttattaaaactgtctaagttttgtccgtttacacatttcacaattaaaggactactacaacaattttcctaagtcctcctgctttagtttctccttattccagtccattctgcagttaagacttaaaaagttttaaatactgctttcaaataatacttgcaacataattccctcaactccattagctcctcagagtaccatttctttatcttctttccttttactgccaaaaagacgtgaaaaccactagctcagctgctatttttctatctactgaaatttttcttgtaaagtttccatcatttctgtatattcccagtgctttggccccttaatcctacttaatttttgtagcttttaagactgctaatgactcctcacctcctctggcttccctaatgttgtatccactcattttcttccatctctctaaaggcaataaggtcttctgctagttcatcttcctacctcatacatggcctctctccaagtttctgtcaatagccacttttcttaacctaaaccaattttctgcgcaatgtcatccattcccatagcacctctatgcttacaaacccctaactctgtatctttaagtccttatgtctggcatggtatgcctgcaactacatattaccaacggtacacatccatttggatgtctcattaacatctacattcaacgtatctaatatcaaactcaattattttcccaaagaactcactctgcctaatctcactgtcctggttaaggactaaaaaaattggtgccattcattactttctccccctcatttttatttgccctaaccactgtgtaggttgatacttgttcagccttcaaattcttcataatcattaattcaaaaactgtctactagattttgagtgcctactaggtggatgaagatgcagaggtagaaaaactagacataatttcttgccctcatgtggtgaaggaaatgggcacaaataaaaaccacaattaattatgcaataacaatgcacagttaagtgttgtgatggagagatacagggggtgttaagttgtgtactgtaataaaaagtccttagtctgaagaaaaggaaaaccattctttatgagggacaagcaagatttacaagacacactaagaaaaaccctgtgaggtaatgatggtagcactatcagtccagctgctcaaattggaagattctcagtcatattctaaagagtctctctctttcccagtatatcaaattgtttaccaattgctaccaattcatccttagaaattcccctacatttctacattctcacattattccccagtcttttttgattgcttttagttgcttccagaataaagccaaagctcccaatcacgtcagatgagattctacacaatttggtcaaaacctgccagtgcagcctcttcttacagactagaccagacttcaagagaacatgtgtatcatttgcttttatacttccagtgcttgcaaatgtttatagaataagcatcttacaaaagagaaaatttttctcttagggaactagctttcagtcctttagtaaatgcaaggttaagattcaaaccctaatttgtctgattctaaagaccacgcttattcccttgtacttgccttctaatttatactcaaaccctatgaatttccttaaaaatatctcttactccttttttcctcaaacttaccaacactgtcctactacagtgccccattatttcatctggtttcccttttgcctttatcctcaactttgccactagaattatcttcctaaaaactcaaagttacacatatcattctatattcaaaagctttaacactttctcatgccaacagaataaatttctaactccttcacattttatttgaggcccctgccatgtggccctgaccccagccatcccagcactactgcccactatatgacatcatcaccagttaccagatctagtcccatcatttgactattggctataatgtactggatatttgtgtttctgacttcaatgcttttgcttctgaggagacttcactcggaaatggtcctctatccattactaacctctatcccccacccacctatcatgccatgttaaaaactggcctcattctaaacactgtatctcacagggttatctaaactcttatacataatcaccatctccttcatgtcttattatacattcttaataccataaaataatttattaatttctccttatatttattatgttataccttacattacagctatctgtatacatttgtcagtgcctctagttgtaagctgattgatggtagggatcatctcttccatattttacttttcgtaataatggtgactatgttttcttgacaccatacctcccctctacaagaaaaaaaaaaaaaaaaaaaaggaatcaggacccatggcctttgagctagttccaaatgtgactcatagatgaacaaagataccatttcttcccaaattaacacaaatataagtaaatgccaatttaagaaacgttttttcaaagactaaatatgtaagaataaccaaaacaattgtttctaataatgttcctttctctaccagatattaaaacatattaacttaaatggaataattaaaatcggcatgcctttaaaaaactgagtatacactaaatatatgcataccttatgacttaaaaatttcactcttaagtataccaaacagaagtaaacatattcacaagaagacaatcactgaaatgtttagagcagcagcaatattcttaacagttccaaaccaaaaatgattaaatgtccgtaacagcagattaaactatggcatattcttaaaatggaatatcacttccattcttaaaatggaatatacagcgactatcataaacaattactacaaccaacaatgtgaataaatctcacaaatacattaaaagaagtcagacacaactaaatgtgcttgattctagttaaaggatgaaaacaggcaaatctaatctatgctatgagaagtcaggacagtggttacacatggaagaaaaggggtagtgacacagagcacaaggggctacgcaggagctgctgctgttttttgatctgaatgctagctaaacgggtgctcagtgtgtgaaagtgcaacaagctatacacttagaagtgtatagcttaaaacattctaaaaaaaaaaaaaaaaacctcatatggtattagcattagacaaagaggtaagcacaacaagcacaacagaaagctaatttcagagaaagatccgaaagtatctgacagttgctccttctcaaacgagaattttcagaccttggataacaggcagcagaggactataatgcatgaaaggacaaaaacaaaggaggtgagccatccactgcttggatgtctgcctggaggtaatttccaacctgcagtcaatggaggggaaatccagtgagaagacagcagttttactgagttcagaatcaagagatcagagctgagaaagctgaagtgggtaaaattgatgacaagtgccagacaagtgcttgtctgagaaggcagagaaatggcttcagaaatctgccatttgagagtccactgctgagtactaactgtacacgattaaggtaagtgactccatgaagctagtgaaagaggggcagtaagctgaaatattcccagtacttataaaggactgggagactcctaaaattctctctaacctgagtgaagagaacacggtgacactgggagcatttagtaaagactcagaaggatcatgccttaggtaggagctactaccattaaagcaaagccttctctagacaaactccaatgtagccctgaagggataaaactgaccagcaagttatttaggtggctacaaaacaaaacactctaaaagaaaacaaaatctagacacccaacaacaaaatattacaatgtccagcatccaatcttaaaaaatcattaaatatgtaaaaaacaaaaaataaaataaaataaatactaggaaaatacaacccatgaccaagagaaaaaaccaaccaacaaattcagagtgaaaaaattcaagaaatcaataagtaacctgattttcaaacagctattacaaatatgctcaagaattcaaaaaaatacatgaataaaatgaatcaaatggaatttcttgaaatataaagcgaaatatctgaaattatttaacaagggaggagaaaaaacagtaaaatagaagacaaagcaaactgaagcacagggaaataaaaagactgaaaaataatgaatatgatgttaatgacctgtggataataccaaacagtctaacatatgtgtaactggagtcccagaaaaagaggaaatgatgaaagaggagtaaaggtggtaaaaaatatatatatagaagaaacaatggcaacaatcttccaaatttaaggaaaaccataaatgtacagattcaaaaagaaaaaaaaaacaaaaccccaacaactctcagcatggtaatcattgtgcaaatatcatagaacgtacttacacaaatctagattagatggtatagcttactacagaactaggatacatggtatagcccgggtgctcctaggttataaagctgtacagcatgttactatactgaatgaatactgtaagcaactgtaacaaagtgtaagtatttatacatctaaacctagaaaaggtacagtgaaaatatggtggtataatcttaaatgactattgtcaactatgatctcgttgactgaaatgtcagcatgcggcacatgactgtataaccagacttctcatcaaaaacaaatgctgaaagaaaaacacatcaactaaccaagaaaaaagaaacatatatgtccacacagagacttctttttttacacaaatgttcattgtacctttttataatagctgggaactgaaaacagcctggaactgaaaacagcccaggtgtcccttaacagatgaagtcacaaaccaccgaaacattcaacaatatggatgaatctcaaaaacattatgttgagcaaaaagaaactttttacaacatataagtattgtatgactctacttacataaagttctgcgcaagctaaactaagatgaaaacaatctgaacaatgttaggttctaggggtggtgtggggggaaggaataactaggaagaggtgtaggttctataccctgatagaactttctggcaaaggtgtatacatttgtcacagctcatgaaatggtatatgtggtcaactgtattttccaaagatggtcacaatagaagccattccacatgctcttaacaatgtaacactgtcattttttcatcaggtggtggagtctatggcccttctccttgaatctgagtgaaattagtgagtctttcaatccaaagactacagtcatacctcaactatctacagaggactggttccaggactcccatggatcccaaaatccaaggatgcttcgaatcccttatataaaatggcatggtatttgcatataacctacatgcatcttcaaatatgttaaaccatctctagattacttataataccaaatacaatgtaatgctatgtaaacagttgttacaatgtattgtcaaagacaagctctccttgccaatccctgaccaaatgagagattcatgagcaaaataaatagttgctgatatttaaggcactaagtttggggcaatgtattacacagcaataaataactggaacagcatagtaaattctagttaaaaatactaaactactaagttttagttaacatacatgctcaagttaagggtgtggtatactaacaactgcaacttactttgaaaagcataaaaaaagacactagaagaagacaggatggatagatggacaagatagaagacaataacaaatagaacaaaatgttgtgaaattatattctacaattattttaaagtctgtgtggtttgaaaaattgtacgataaaatgaagagtgaaataaagacatttccatacaaacaaaagctgaaagattttgtagccagtagacctatactttagaaatgtttaagaaattttttcaagtaaaaggaaaataacaccagcaacaaacttggatctacaaaaaggaatctccacaaagaaaaataaataaaaatggtaaatatgaaggtaaatataaaggaatgttattcttagtttttaagtttcttcgtaagacaactggcctttgaaagaaatagtttcaaacgctgctgtggaatctataacacatatagaagtaaaatgttaagatcataataccaaaaagaatgagggagagtaaatggatgtatactattccaaaattcttacattatacattaagaggaataatatttttgaaggtagattgaggtaagttaaaggtgcatattgtaaatcctagaagtatcactggggggaaaaaaaacagagggacaagctaataatggagacaatacaaaattccaaaaatgctccattaaccgaaaagaaggcagaaaaggaagaaaagattagacaaatagaaaacaaatagtgtcttaaacacaattatattgccaactgcaataaatgtaaatggacttaatcaaaaagcaacgatcgtaaaaagtcaatctgaaagcaagatgcaactatatgctatctaaaagaaagacattaaatgaccaataagctgaaaataaaaacacagcaaaatgatataatgtgcaaaaattaatcataagaaaggaatggatacactaatatcaaagtagactttagataaggaacattaccagcgataaacagagacatttcataatgataaagacatcaattaatcaaggagatctaacagtcctaaatgtgaacacacctaaggacacaactttaaagactttgcttcaaagcatatgaagaaaaaatgaacagagcagaaggaagataaactcaaaattatagttgaagatttcaacattcctctctcggtaattagtaagtggacagaaaatcagtaaggatacagaagaaatacatttatctatctgacaaagaacatatgttctgaaaagaatgtgaaaatatttgaacagacacacaaaagaaaacttctcaacagcagtcatgaagaaaatgtaaattaagaccataatgactttttacacccattagaatggcaattattttaaataaaaaacagaaattaccaagtgttagaaaagatgcagagaaattggaacccttattcactgctggtgggaatgtaaaatggtgcagtcactgtggaaaacagtatggcagtctctaaaaaaattaaacatacaattaccacatgacccagcaattccactcctaagtacataaccaaaagaattaaaagaagggactcaaacagatacttatataccaatgttcatagcagcatcattcacatagttaaaagttacaaagagtccaaatgtccactgacaaataaataaataaaacaaaaagtgatatatgcacacaatgaaatattactcaaccttaaagaatcaaatttggatacatgctacaacatgaatgaactttgatgactgatacggtttgaatatttgtcctgcccaaatctcatgttaaaatataatccccaatgttgggggtggggcctggtgggaggtaactgggtcatgggagcaatccctcatagcttggtgctctccttgggatacagagtgagttcgcagatgtggtcgtttaaaaagggtgtgccacttccccaccctctctcttgctcctgctctcgccatatgacacgcctgctccccctttgccttccaccatgagtaaactcaccatgagggctccccagaagctgagcagatggtggcgccatgcttgtacagcctgcagcaccaggggccaaataaacttcttttctttttaaattacccagtctcagatattcatttaaggcaacgcaagaatggcctaacgcaaggacattattattattaaatgaaatgtgccagacacaaaaggacaaaaatcgtatgattccacttatatgaagtacctggaagagtcaaattcacatatgaagtagaacagtgattaccagcagatagggagagtaggcaatgaagagttactgtttaatggatagggtttcagactgagaagatgaaaaagtttcagagatggatagtggtgatggctgcagaataatgtgaatgtactttatgtcactgaactgtacacttaaaaatagttaaaatggtatatttgatgttgtgtattttagtaccacttaaaaaaaaacactgcaatgggataccactacacacctctcagaacgtgtgcaattaaagactgagaacatcaaatgctgacatttggagaactggaactctcatacactgatgatgggaatgtaaagtagtataatcatctggaaaatagtttggcagttccttatacatttaaacataaacttaccatgtgacccagtaattccaatttaaggtatttaccctagaaaaatgaaaacatatgttcacacaaaaacatgcacacaaaacagtacctttattcgcaacagcctaaaactgaaaacaatttaaatgttcaccagaaaatgaatgaactgtggtatagtcatattgtatttaaaaaaacgaaacaaacaaaaatctgtgacaaacacaaattggatgaatctcaaaaacatgccaagtgaaagaaaccaggcatggaagagtacatgttacttgattccatggatatgcaattctagagtaggaaaactaataaacagatcagtggttgcctggggccaagagggagaaatgactacagacaggaaggaactttttggaggtaattcaattgttctaaagcttgattgtagtagcagtgatagtgtatatatttatcaaaatcaataaaactatatagttaaaatgggtgcatttcattgtgtatcaattatacatcaataaacttgatttttttcaaagtttgtgagaacttaatatagaaaaaggtggcattatcagtggggaaaggatgccttacaagacaatcagctacccaagtggaagaaaataaaaggtagatataattcccaaaccatgacaaatgcaatccagatctaaaccatatcataccatatccaaaaatatgctgaatgctcatatctaactttctaaattaaagtctataaagtaaaatcacaaaagtatcagaagaaaatacaagagattggccaggtatagtagctcatgcctgtaatcccagcactttgggaggctgaggtgggaggatagcttgaggccagaagtttgagaccagtctgggcaacacactgagatacgttctctaccaaaaaaaaaaaaaaaaaccaaccaaccaaaaaaaaaccaactagctatagtggcacatgtctataatcttagctacttgggaagctgaggcaggaggatcacttgagcccaggagtttgaggttgcagggagctatggttgctccagcccgggtgacagagtgagatcctatctctaaaaagtttttgtaatatatatatgagatcatatttatatcaactttgttagcatgctgaaacccagaaaccataaaagatggacagatttgcctacataaaaactttaaaatttcacatgactagatactataaaattaaaggtaggtagagataatatttgcaaattataataaagaattaaatgatatataaagaatgcttacaaatttaaaaaacaaacaccacaatagaaatggaccaaaaaaccaggcaatttcccaggttatttataaagacttaaacagattttatatatacatgaatcaaaacaaggtaaatgagcagtccctaatatattttaaggaatgaaacttgctaaaattattttttaaaaggtaattggcaaaacctatcaaatatttagattgacatgatctaatggcctgacatcttatttgtaggaatctaccttacagaaaaaataacaggtaccatcattgcaaaagcaaatattgaaaacaaccgaatttccaaaacaggcaaagggtctcataacatcatgaactctcagagttaattcctagttcagttctaaagattgagagaacacatcagatttagagtattccatctcaggtttctcaaggacaatttttcattaaggcctaatttattatattttaaaacatgcttttccatccttttttctgtttttcctcttttccccccacaagcttatatggtaaaattacctgtagttaagtgggcatgtgatatgatgcacagatttaatgcaataatttataagaattatccaactccattctctcagctgctctggtcaaaaaactttggcatcatgttttactcctccctttatttcccactttcatctggtctactaccaaatcctatggactctatttcaacatatatcaagaattcaaccacttctcaccaccctcactgtgaccactctgtccatttcagtcacgtcttaatctgtactaatggtctaccaattggtctgtttctgcccttgtcccctttttcagtctatgattaacacagcaaccagagtgaccttgctaaacataagtcatactttttcactactctgctcaaagacttccaatagcttcccatctcacttataggtaaaaatcaaacaccttattatgatcaaaatatctgtaccctccattctctctatttcccatcaattacttttctaaagctacactggccacacctcgagttcttcaaacacatcaggcactctcactttggggtttccctattcactacactctgcctgaaatgctcttcccccaaatatccacatggctagctctctcatctccctcagttcttcacccaagttaccatttcagtgaagttttctctacctaccctatctaaaatttcccatcatccttttcacctgcaaacacttcccttatttgtttcttctccttagcactatgtaacatatattttacctatctttatgatctctttttaggatttaagtgccatgaaagcaaaggactgagtgggttttatacactgctgtctctaccaggacctagaaaaaaaggcccactacacagtaggtgttcaagaaatgtttactaagtgaatcagatggatgtgtatgtagccaaccatttgaaagattcctataacacagttaagaggaaaaaaaaattatatgaaacacaagttttagtacacaaaaatctatgcacaaggaattaaaaacctgaaatgaaattttaaaaaattcaatttgcaataccatcaaaacataaaattcttagaaataaatttttaaagtaataagtacaagacctgtatactgaaaactacaaaacatgaaagaaattaaagaacaccttaataaatggaaagatatcccatgctcatgaatgagaagacagtattaaggtagcaatacttcccaaatagacctacagattcaacacaaatccaagtcctattaaaatcccagttgcatttttttgcaagctaaccctaaaattctatggaaatttgagaaacccagagacccaaaacaattttgaaaaagaataagttagaatactcacatttcctggtttcaagacttactacaaagctacagtaatcaagagtgtgtgttacccaaaaaaaacagacatacatgtcaatgaacataccttgaaaataccatggtaagtaaaagaacccacacacaaaaggacacatactgtatgattcccatttatatgaaatatccagaataaataaattcatagagacaaagcagattagtggtttccagaggccaggaaagaatggggaatggctgctaacaggttaggatttattttggggatgatgaaaatgttctaaaattcaatagtggtgatggctgcagaactgtgaatatactaaaaactttaaaagggtgaattttatagtatgtgaattatctcaataaagctattaacagttttgaaagttagagaatatgtttggtaggattttttttaaatactgcctccccaaaaggaaaaaagctgtatgtatatcagtacttttacagctatcttacattttatatttgattggtaatttccttccaggcatttttttccctctacagttaaacacacttaacaactgttaagttttagaattggctatgaagcgaagagaaacctttcatttcttcttatacttaaaaaaaaatagctttttatttttcttttctgtatttcctcatcctcaaaaatagattctacacaccaatatttgagggatggtggggcaactaccacaaaatacaagaggctctcttctggaaatgtaaaaatgttagaattcctaggaacttttcatgatttatgagcctaacctaacatttaaaactgagcccatgctggtaaatctgggctacacagtcatacatacatagaactctggaatcacaacacatccactgtgcactggaagagtactgtaatctccttctaatgtgcaccttggctctcccctcccttgggttctttgaaattttttttttaaataaggtatgtttatttcttatttacctactaactacagaaggtagactcacaatgtgccaatattaaaatgttatcattcctcattaaaatatttacttaagtgttttattacatgacttaccagcaatggaagaatctcatctgagagtagttctcaactgtcatctatgaaaatctttagaaataccaaatcatcagaattactttaatttcctggcttttaatcataaagcattcctactggtcaacaattctacaatctgaaaacagggacatctgtaccatatagtcccaatgatttattattctgaaattttcctctgggttatttttacactgtaattagagttcaaacttccatagcgcctagcctaaaattaaacccagaattatgccaatttatgcctgctatatatgcacacacaaaagacttataatgcaatatactaaaagaactaaaggtaggtgggtttttccttgaaggaatcatagctacattattttcaagtttaatctgttacattcacctgcctatcaaataaatgtagcacttaaacgcataaaacaaaatttgatttagtgacaaaaaaccattagcttctaatttaacttcaaaacgcttttcaaaaaatctaccccatctaattctaagtgaaccagaccacacttgatagaaaactgttgttctaaaaaccatacgtacttaacacaaacagtaaacatatgagaacatttagtcttctattaatgtcttacaaaatatttcaatgtggctggttataatttttttttttttaagggacagggtctgtcaccgcggctggagtgcagtggtgtgataacaactcactgcagcctggaactccagggttcaagcaatccccccacctcagcctcccaagctgggctaattttatttttcatagggataaggtctcactttgttgcccaggctggtctccaattcgtggcctcaagtgactctctcacctctgccttatatttccgtttgagctgttattatcaactggagtaacatttctagttggggaaaaaagaactgatccttatctgtagatgaacacttatacattcagcacttacaaataactgaatgtgggcatgaaaaaaagaatgacagatgataaacatttactgttctcaaaataaattacctaatctcagttgagataaacacgactcagaattcaattaacagtataatataaagaagccccaaaccaatgagtgcaaaaagaaagactctcaaggaaggcttccctgagtaatatttaggttgagccctataagatagaaggaagatggataactcaagaaactaaaagcagcctgtgtggtaagatggtactgaccaaaggggaatgcacaggaaggtaaggctcagaaagtagacagaaccctatcaaagcaaaattttaaatagaaagcactcttctatttcaaaataactgttatttgttcacaataatacaaaggaattataaactactaaaactaacaaaccaaagtgggcaacataggaagaccccatctctacaaaaaaaaaaaaaaaaaaaaaaaaaaaaacccacaaaacttagcagggcctggaggtgcctgcctgcagtcccagctacttgggaggctgaggcaagactatcgcttgaggccagggggttcaaggatgcagggagctatgatcatggcactgcactccagcctggggaagagagggagaccctgtctcctggaaaaaaaaaaaaaaaaaaaaaggtgggtggggtggggagaattcaataattaggacgaatagactttaaaatgtagtttatacacacagtggaatactactcagctataaaaataagaataaaaccctgtaatttgcaggaacacggatggaacaagaagccattatgttaagtgaaataagccaaacacagaaagacaaataccacatgttctcactcatacatgggctaaaaaagtatatctcaagaagataagcatagactggtggttactagcagccgaagtggggagtgagaggacaaaggcagaagaacataactgtatttattattgctgaactgtacacttaaaaaactgtacacttaaaaaatcattaaaaatgaactgtacacttaaaaaagatggtaaattatgtatgtatatttaacctcaatacaaaattttaaaaattcaatacttaatgctggaacaactagcttttcatatttaaaataaaaaatcctaactcctttcagatgaacctaaatgcaaataacaaagagtaacaaaaaatcctcaactattagcagacaatataaaaagaggatttcttaaacaaaaagcacaatcataaagaaaaagacatgatttttacatcaaaaattaaggctcatactaccagagaatactacaatgggcaggattttatattttactcttattctggtaactttctttggctgcactgtaaagtaagaaggttggatgaaatgatcttcatggtccttttcaacataaatgttgtacgatagtgtgcctttcctttaaaaacatttatttttgagatatttaaaacatacagaaaataataaatttcctatccttttacctacgattcagaataatcaagcaactgtaaattaaaatgagatagcatttcacatgcctcaaattagtaactattttaaaatctgacaatcccaagtatgggtgaggatgctagaaatgcccacataatgctgataaagtatacatgggcatatccatttaggaaaagaatttaccaatatctagtaaccagcaatttcacttctacggtttttcccaaaacacctgcacatacactcatgtaaaaataaacactgcagcattatttataatagcaaaaagaaaacaactcaaaatatccatcaatagtgggacacatacattttatctatgcataaaatgaagtgccatacagcagtgaaactgaataaactacatgtacacgcatcaacatatacacctcaaaaacttgatactgagtttaaaaaaatcaagctattgaaagacagcgttatacatgtctgtaaaaatttaatacaaaaaccaacaccacatatcacttacagatacatgtacacatgtatagtaaaagtataaaacaaggatgtgaaatttacttaagaatctcaagacagttgttactttgtgtagagacgggtaacaggacttgaacagttggggttgttaaaagtgattatataactgcatcctttcccccaagggataaaaatggacataatttatatttccaggtggtggataaataggcacttgctatgtcattttctggatgttttaaaaattttacaattaaaacatatacacttattttaaaaacaaacaaaagacatattagcatataatgtccaagctgataattaccttggaagattatctaatataaacctccctacttcactaaaaacaaaattacaaaagatatcagaataaaaatatgatacaggctggacgcagtggctcatgtctataatcccagcactttgggacgccaaggcaggaggatcacttgagcccaggagtcaagaccaggctgggtaatatagtgaaacttcatctctacaaaaacaaacaaacaaacatttttttaagaatgtaataggattggtgtggtggctcatgcctgtaatcccagtgctttcagaggttgaggcaggcagatcacctgaggttaggagtttgaaaccagcatggccaacatggtgaaaccctgtatctactaaaaatacaaaaattagccgggcgtggtagtgcacacctgtagtctctgctactcaggaggctgaggcaggagaatcacttgaacccaggaggcggaggctgcagtgagctaagactgcaccattgcacaccagcctgggcaacagggcgagactacatctcaggaggaaaaacaaaaaaaaacctatatatatatatatatatatatttatatgtattatatatatataatacatatatataagattatatatatattatatatataatacatatatataagattatatatatattatatatataatacatatatataagattatatatatattatatatataatacatatatataagattatatatatattatatatataatacatatatataagattatatatatattatatatataatacatatataagattatatatataatatatataatacatatatataagattatatatatattatatatataatacatatatataagataaatactattgtagcagggcaattttggacaaatactaggttatctgaaacagcactttggggaattagatcttgaccatttaagagagagattagccccagtttctcaaaatctggcactgactagcaatatggacaatgtgtgcaccgccctcgttccacctcccctcctaggaatgccatgtcaaattcagcacaggcataggcagtaaaactgacccctagttctgcctatcactatttaaaattactttaagtgttgaggactgtccccacagcagatatctaaaagtaggcctgaaagaactagaaagtagttcatgcatccagcagttacaagtgcctaaaactgtacatgaaaaaacaaaacaaagaaatgaactgagagcaaacatttactgttttcttataatcttcaatccaggatttaagaaattatttaatatcagttgagatacgtgaccaacccattctccagctgagatccatctatttttaaattcactcccccagcctttcattcagcctaaaagagggaataagaatgggaaggtgggaaggacttatcccatactgagttaaataagaccacaagatcttttcatttttacaatatttgaaatacagtacactgagcaataaatttaaagaaatatgcatgatttgaaatgcagaaatcttgatttatgtgtataaaagaccaaaattagctcagttcgtctaatacactacacttaagtgttcttcaatactacagtcaacttttcagaaatattcccattctgtgaagcaggatgtattcctaccttgattaccaaactttatccacgtaacttcctattctcccactctgttctttaaacatgttcaacatgttacagagatggcaaaatgtgttacaaaagggaatgagaatgaagcagcttaagtaattaggaaaactttacacttcttagaaactgaatttgaatgatcttaaacagcatattttcttttcttttcttttcttttttgagatgaaatcttgcttgcccaggctggagtgcaatggtgtgatctcagctcactgcaacctctgcctcccaggttcaagcgattctcgtgcctcagcctcccaagtaactgggattacagacgtgtgccaccacgcctagctaatttttgtatttttagtagagacagggtttcaccatgttggccaggctggtctcgaactcctgacctcaggtgatccgtgtgcctcggcctcccaaagtgctgggattacaggagtgagccaaggcgcccagcctaaacagcatattttcaatcaccaacacacaacatgaccactgacttcagaaaactaggaaagaaaaatgttacccaattaatctttgtgtgaaacaggatttatccattagtatacgtatcacataccatagatgcacaaaagattttttcaattcccaaaacaaaaacttaaaatatttagcaaagataatataaaaatccttatttatggcacgctgtaagattatcaatattggtgcatataaccacagaggcacaatagaattcttaggaaaaatgtattaagacaattaacaagctggaaataacccatatttccccttatgacccattagctttatatagaaaacactgctgtgcacttcatcctttgctttctaaagaacagcattatggttcacatctgttaagagacaaaaaagtatttgttggaagtacgaaaggaagaaattcctgtactgttacatgcagtgccaaaggaatcatctgagaagaaaataaagaacatgagtttaacatgagctttagagagggattacaagagtgcaagaaagtgacaaaatgtgacatatgtccatagtgaatacatggtgctttattgttttcagtatttctatatttaattaggaggtggaaagtttcagaatttattctgcatcacaaagattataaaaatatatgagttggggtgttggctacagtacacaaaggcaattctaagactacttattaacagaagcttgaaatggaaaagccatcccttctgatttcattacatgaaaagaacctgtgtagaagtacagcaatggtagcatcttcattcagcccacagctatgtaatttgtatgcaagagtgcttgtcttaaatatgaaaaggaacatcctgaattgctgaaagtatatacaacgggcacacatccagaactaggaaagagctaccaagcctgcatgctacgaagacatgggtcaaaaaatttttctcatgtttggtttctataactaaagtctgtgctagactaacctcaattgatcctgaggagatgaacttctggaacacacaaaactgttaagagtcacagcattagactctacactgtccagccaacagttttaagaaaaattttatcctacttgtatgagtgttcagggctcatatactacctctatgctcttacttgaaacacagatgcagaccttaataaataaagtcttacatcagactctcttctataattcacatgtgattccttacacgagattcctgttcagatttcctgaaaatgaactataggaataatcttatccaatatgattctatgtcccctaaaaatatcttttcctttcaggtcaatcttatgattcacttgccattgatcagattaacacaacaggtctggtacagcaaattacaaaagagatttgacttttgattaatacactgaataatgtatcacaaactattaagatccattgtccatgtcaaatggagttcacatatttaaaatgaattcacacactaaaaattccccaaaacaacgtttctaaaaagtttttttttttttctttgagaggcagtctcactctgtcgccaggcagtagcatgatcttggctcactgcaacctccgcctcccgtgttcaagcgtttcccctgcctcagcctcctgagtagttgggactacaggcatgcgccaccacgtccggctaattttttttttgtattttagtagagatgaggtttcaccgtgttggccaggatggtctcgatctcctgatctcgtgatccgcccgcctcggcttcccaaagtgctgggatgacaggcgtgagccatggcacttggcctctaaaaagctcttaatctacattttcaagaatgatcacgtttgaaaagcatactcttttaaaacaaagcaactatcactttcatttgacaaaagaaggaacgaaggcttcaaaagctaaataacctgctcatgaccattacgaagctagttaaaacaacctcaagaccaaaagacagtgctcattccatttcaatgactctgatgcacttaaaattttataaataatttttagggatatcagtcataaggcttagaatcaaatagtaacgactcatgtacaaagaccagtattttttaaaaatgctcagctgggcatggtagctcacacctgtaatcctagcaccttgggaggccaagccgcttgagaccaggagtttgaaaccaacctgaacacggcaagaccccatctccacaaaaaaattaaaaaataaaaaaattagccaggcatggtggcatatgctaatcccacctactcaggagggtgagatgggaggatcactccagcctgagactgcaatgagttatgacagcaccactgcactccaacttgggcaacacagcgagaccctgtctctaaacaaataaacaataagtaaaataaacaaaaagaaaatgctaactttacttcactctcagataggcctaataattaataagcttctttttgaattattatccataatggcatttacctgttattgataactcagatcaaagcactactaagcaacatttttgatagcaaatgaaaacaaaagctggcaaagaaactgtgtattaataagtcatttgattaaaaaaaaggacttggccaggtattgtggctcatgcctgtaatcccaacacactgggaagctaaagtaaaagctgaggagttcaagaccagcctgggcaacacagtgagacccccatctctataaaacaaaaatttttaatattatctttttacaaaggacttatttatatggcatcttcaagtatttcaaacatttcgtgtttggattatggaatatgtctccagaagaattaacactatttctatttaaggtaattttacatcatttcctttattagaagaaataacagatctgcagatggcattttgtgaaggctgccttctattaatagtgtacaaaacactcatatgtctccaaaaaggtgggtgagtaatcacaaagcaagtataactattcatcccaaaaggtaggacagaacatgtgccaatgtgtgcagagtcctgaactagagacatggactctggttctggttctgacacctgggtgactttaagaaaatcattttaaagctttgcactccaatttcctcttgtataaaatgactggagcagctgacctcatagacaatcctactcaggtagcatctatccatgtactgccagaagacagaatgataatcatgccccccaaaattagagtatttgaagacaactgccggagtaaaaattttaaattctatatacatacacacacacacacacacacacacacacacacacacacacacacacacacaaatactaatacactacgtgccagatactggggtggtgggctgggaccaaggaatgaagtaatgcatgtgccagagggttgaactttttaaaaggagtaaaaaagtaaatctttacagtagcagctggtgggtaggaggtattgagtccatagaactgctcttagattggaagggcatgggaaaatgaagttccattatgtgatagggttttacacacacacacacacacacacacacacaaatgtgagaaagtcactcaactataagcattcaaaaaagacagacatctttcttgtctttgtgggtcctgtacttagctcagctcatagaagccacaggaggaacctaataaatgttagttgatcatttactgatttaccaataaccaattcatgcctgctctagtgctgtggtctgaatgtgtcccccaaaattcatgttgaaagcctaacctccaaggtgatagtattaagaggtggggcctttgggaagctttgccatcattaatggaattaatgcctctataaaagaggccctatagagccccgtctactcttctactacatgaggtaatggtgaaaagacagctagctatctatgaacaagggaagagggccctcactaagatgtcaaatttgttggtaccttgatcttggacttctcagcccccagaaccgtgagaaataaacttctgttgtttataagccatgctgtctgtggtgttttgtaatagcagccagaacagactaagacatctagtaacacattctctggtaaacactaggaattcctggccttaaaaagttcatagctaatgagaaaagaaataaacaacataaaggataacatgctgtagtccactacatacaaggtgcttccagaccattcagaaaaactggataggaagatttctaaggtaatacttattgagtgcctacgtgttaggcgttttacatactttaagcctcacaactctggggaagtttcaccaacccattttacagatgacaaaactgtggcttaccaagattaataaggccagaattaaaattagggtctaattccaaagatattaccactatacataccaagatgtcttgttactacattttatccttacatttggcagtgaggggaaaactcaaaaagcagtcaaaaaacttttgtcctgaaccaacataaaaagagcacctaagacttcatccagtattttaccgaaagatcacttctaaaagtttgtcttcaccccgatctaaaaattagaaaactaattttctttcagcagctgcatatgtacataatgtaatgtttctacatttagacctacacaattataagtctaaacaaaatatgtgtaacatgattggagaacataactagcagtcatttaagaaaatggacatttggaaacatcatttcaagagcttgggatgaaaaattttgctatgacctataaatctggatcattccactgactgacactgagagaaacagtgtattatcacagtttacacagtaaatttttttggaggggagagggaggagattgaaatagaaatgatcgaaatagaaattatctaaagtttaagaaatacaactgattaaatgttacatgtcaaagacactgtaggtacccaataaatcctgttaaatggactgcacaagtgggatgagaacacgttttccccacacctctgactagtatgtacctttcttaggaagttattttttcagccatgggaaaaaaaagggcagaatttaggacagataaaacataagtagcttataaatcctctgaaaggaaatcaaaacacagtattttgtatctctgtataaagttaagctcctcagggacaggggcaatgtccagaggatagtgagcatactacttagcaaactaatgcaggttaataaatattgacacagtaagactagcatagtttacattctaattttgtaaagattataagttacctcttcatattctgttcttttatttctcctgtgtatattataaatacacaaagattgaaaattatttcttgaagctatttccttttttattttttggtcaactgtattagtgtttcttaaaagggcttctggtcatccttagggcttatcagtagcatcattaataatgtattcatttcactaaaaatgtggtaagtagcttggatttaaaaacaggatctaatttcaaagctatttccactatacacaccaagttacaactttcttatctctcctaaattctaaattttacatgatttaccaaatcacttcttaagtaagagtacttattgatcagaagtgtgagacaaacaccttatcccacttgtccaatttattcaacaagattgattgggtacctttgtgtctctgacaggtaactttcaacagttgtatttcttaaactttaggtcgtctcccaaaaaaaactgtaataatttgctgcttctctcaatattgcaggcagtaaaatgatccaaaattacgggtcatatccacatttcttcatgattgaggttaactgtgcactgtaaaccccatatgctattagtttacattttcaacagcaccctcgccacttaataatctcaaacagattttggactgttactaatttagcatatccataaaaagtcatttaaaaaatgtagacgctaaattctctttcaaggttgccaagcttcaccagtgtctgtattaaaattatttctaaaattttacggactaaggcatttggtacattcaattctacctttaccaacaaaagcctttaccaccaagatgaggaaagcatccttttcattttctacactgaaaaggggggggaaaaaaggccaactgcttgcatacaggtctgcatataacacagcagtctctggcaaagccaataactcacgttcaacttcagaaatcctggtggccggtaacacagagtaacctgtgcgcacaacccttgggcttgacataccacttcatccgccctcccttcccatcaatccacccccaaaaccccaacccaccaagcacacggctaaatatgtcttccccaagagagccaaaaaccttgaaaacgccgagaaagggctcccctttgaaggaaagggcctgcccttccctgtctggggccccggctggctcgaagagcctggctcctaggaggcccaaatctcgacgcctcgcacgtcccgccccgccccgggcccgctcgcgtcccctcgggcgacaaaaccctcccgccgtcgctcagccaggactgacagttacggctgcagcagccgcggccaccaggggcctacttctggcaccagccccttcggaccacgcgcccccaaacactcgcctcggcggcggggggcggggaaggggggtgtcgacctcgccacagcgggccccgaaggccggccgagtgacggaggggagccagcgccgcctggcgcaggccgcggcaacactgacctgtcgtcgcccccgcgcctgggctgcggcggccgcctcactggtcgtagtcgccctcgcccgccgcctccgcccgccaccgcctcgttctctttcgctgccgccaccgccggggctcatgcgggacccgcgcttccttatccggaaaacgaggccgggaaagggagcgccggggccgccgaaatcccggcgttcgtcgccagccgccgctgcctgtccacaccggggggctgaggggccctcctgccaggggctacaggccgcgagctattccgaggaggagccgaaggaggcgccgccgcccgcagccgagcgcgccgggtcggcagaggtgaagcgtaagtaggcggcggatggcgggcgcccgcgctggcggatggctacgcggcggaggggtgcgcgagcgagcgaagcctggtgtgtcgggtcctggcgaagggaaaaggccccgtcgtctcctgtagtcaccccgagcccagcgccaccatcttgggagacacacggatctcgcggccgcggcgcaagacgggaggactggct

SEQ ID NO: 3 - DNA, 113476 bp, Mus musculus
atccagggcaacagggttacaagacgtccgttgactccttggggggctcttgggtgacttccctgaggtcctcagatgcccttgccctgtttcccataagaggaaatgtggacatctaggatgcacattggttggcaaacattccattccaacaagcacctagttctacattctactcttgggaatttctgcaaggcctgcccattgctcatgactgtcttttctggtcttttttgcagtcatatgacatgccaccttggaaagcagagaaccacagatatcaggtatgtggaaagatcatggctaaagcctccccttccatatgcccaggcccttcatgttttggtttcaattctgagccaatcggcccttttggaatttaggaataagaaaatagtatgcaatcaccaaacgaagctcgatttaggctatgttctcccatgtagatccctagtttgcaaagttttaaggaatttgttcaactcctgataatagatttctcataattttgacctacttctcatggagagaagatgacatttttagtatgttgggatctcatacttggattcttatgtggccatggtgaataggtacaggatgacaacacaagcctccagggccatttaggactcttcctttcccatgacacagaaggcccaagggacagagcctttcttagggagagagaaggattctatgatatccaacaaggctggcctccacatgaagtgttcacaaagagcaatccctttagcaaatattccaaagatttcaacccacagggaattcacccatgtggagagggtgagattttcatttttgccttggtttccaccaccttccaaattttcttcatggtatcatttggggctcttactgaacctcactgcagaatcactgaggaaacaatggcctatacattcggttgatacagggaaggccaggtgtaaaggaacttaattccactttgattcatgacaccaaggcccaaatttgatccagcagtagtggttaccttcatgtgttagaggctgggcaacccattacagcttaacacaaatggatccatggctagacatttgtcctgtgccctaggcccaggattctcgggagattttcagtaatcacatttcacagtgagtgctgtcatgcaatatagagcttacagagttctgatgccacctttgaactttgaataagaaaccattggttactttaatcacactcgaaatacctatctgtagttgtgttttattgtcctgtccatagttctttgggagctcaacttgagtgttgatccccacaaaattgtgaggctaaggtcacatgtgatgtgcctattgcttctagaggaagcagtaaagctttgttggaattccaggggtcctttgtgcttttaattaggtttctctatggtatgcatgaaaacttgtgtgtgctgggcctggttttagtagaagaggcagccacaagagagtttctgcacaatggcgttctgagtgtttaataaccatacttggaggctaatgttcagaggcagtgaatgggagaatattttttcttggccctccaaggtcattaagtcccaaaggactgtgtgttatctctagaaatgttcacacactgtataatgtcacccgtactcttgttctaggatgctatggtgaccccactaaatgaattctaaccctttgcatgatacagatgctttgcatcttttaattttgattgtggcctcttagagagattcttttctgggacgttttaagcaatactctttttacactatgcttcttcacaccttgaagcactttagaaagatttatacccaaaaacttttaaaagcagttcaggtgacccctaaagggaggactaaagggccatgagctattcatccctcttcttgacaccctagggtgcagaactaaagagctggactgaaggcttctttgtataatcagtaatcagaaaactttttttaaaaaaattaggtcagataacatcttttggggccaatttgattctttggctgttgtagtactccaaaactaaagatgactagatctgactactgctaaggataggatttgtgccctacttcagaaattatactggtgtgagatggagacaaaaatccaatggcatgcttcctcctatggatggccatttgattcctgcctactctggctcctctcctttgtcatttttatcttaattttcaaccatgccaatatttctaattacaacacaaaatatgaatcctaaaattttaaggatccaagtcattttaagcacaagtatctaaatatctatataacttataataagatactttaaatcacaaatgtatgacatcattttgttgttttcaaccacagtgaaatgtcacataatattgtgttaatattaacccacaataataataatttaacaccatgcaataataaattcatattaagaaattaatctggacagatttcatagcatgaatttggataaatttttaaggaaactgctctgacatattttcctaacttttaatatgtttaataggagtttctaaaaatgtttatttctaaatagtttgaatatataattggtgtatgagttttcttattaattaaatttgttctttgacaatttcatgcatgtataaaatacattttaataacacttatttacctcttccccctcctatcattgtcaacccaccctctttaccacaagcctctttcctgtgtttatatctttctgttttgtatgcaactttgctttgcaagggtcatttgtgtatccatagacttcagaattatccattgtagcctcataaactcatggatataaaaataatgactctccttccaccgtatacatcattaccaatagtttagcaaaaggtaggtcctcatgagtcctgcccccaaccatagatggttataatagttccagttttatacagaatgtagatagccactggtactatgagctaatagttgcagtagattcattacatctaggagaaagtagttcataggtcttatctcaatctcctggttcttacattctttttactcccctttatttatacaggatggtataattacccctttagaattgagtacttaactacctgttttgttttacctgttttgtttacttgttttcatgaccatgcatgcttggtaacaaacaaccaagaaagaaaaatatgattaaaggtcccaaattgagatgttatataacacaggacataaagcagtactcaaccttcctttctgatgctgtgaccttttaatacagttcttaatgttgtggtgacacccaaccataaaactatgtcactactacttcatacctgtaatttttctatcattatgaatcagcttgtaaatatctgatatgcagggtatctgatatgtgagctccaaagaggccatgacccacaggttaaggaccactgacataaacggttctaatacagaatgtgtgtgccaaaatatagaaatatgaatggtatacaacatatacttattattctcatgtaattgaaattttctttgtttagtattaataattacatctttatggaattttcttatgagtgactgtgtgtgtgtgcacgtatgcatgcaggggcggggcatatgtacatgacagtgacgaagaatatcaggctctcagtgtttcttaggtgctgctgaaactgttattttcttaaatctgtagtaaacacataacttaagaacataatattataatatttcacttatatttcataattactctctaagtatatattacatatgctataaatctaaggtaatttgtaggcctagtgaaacagacatcaataagcctaatgcccttggttaggatcaggaatagggaaaacatacatggcaagaaatccttcaacctttattgaaagaacttacctattttttttttataaaatagaaatactggatattgtcctgagttgcctcttgtaacacagtctattgatgtgaacatggcaataatattgtattccaatgtgaaaataattccttagtttactgagaatatatagagatgtttaccattagaaggtttgcattaggttattttggtgttcatgtctttttgttccagtcatttaagtgataaatgcagaaagtttaatcttgtagcaatatttattcctcttactttttataaatgtcaaattgtcccctccaaaactttctttcccctattatcatcctactacaatggctcagctaaaggtcattaaattgacctattcctagctttgataaactaaaaactattttgcatttttaaatatgattttgaggctgagtgtctatttcagagtctgaaagcacacctaatcttgcgcgcgcccaactggccagaaagaacgacgctgcaacaggatccttctgcacacgtttattcagtcctgtttcttcattctctatatctcccttgtttatatctcccttgtttatatcttccccttgtttatatctcccctctcgaataataattcttcctctaacccgggcctctcactcttatatactctcagccctcatccatgcacagcaggccacgccacctcaccaggcacgcagcttcagctaatcagggcagcaggggcatatctccatcaaaatggattcaccagtatcctggtacacctgtgcagctctcaagatgtttgtggcttatatgaggaagtcaggtgcaagccatatgacttagctgcagtccctggagccttcttgggattgcccccacacccgctcctcacaacctaatatgttccaagccatatacatatacatgtacatgtacatgtacatgtacatatacatatataataataactgtcttttctttactgtcacaatgaataatggcacatgaaaactatgaaacatttgttgaatcaggtaaataaataaaagctactaatgttctctttctaattatactttcacaccttttgactcaaaaaaaaaaaaaacccaaaacctattttgcaaatcctggcaatggaactgtagtaaattaacccagttatagaagagctaacttgtcaggaacaggattaccaagatcagtgataaacaaaatctcctaaagattgagaattatttcatgatactaatctacatgccctttgatagcaaaataggatttccagaattatttaaatgtgatatcctctttactaaaaatgttcctacataataatttcctacacaatagtttccttactaaatttcattatcaaaatggctccaatgggcagacattagccttaaggtttcacattaaggagaagtttgatattttaattactgtgaacagtttgatattggttacatccaagtattgcgtgaatacttggttacagaaatatatagaaataaaacatgatcaactggtaataaagatgaacgtaactatcagtaaaattgagaaagttccatgggaaaacagatacaaattatacctaaatacaactgtattagtttattataatagctatttattcttttgcaaattgatttctttaatttttgcttttgttatttctgatgaataaaatatcagcattagcatcatgtttagagagagaaatcagcatattcctttgtcattacaagttgttataggctaagatgatcataaaattagttgacacatttaaaatgagtaaaatgtgtatttatatatgatgcatatatattaaatatatgtatatattttatacatttaaaatgagtaaaatatatgtgtgtataacacatatatagtaatatattaccatatataaaataagtaaaatgtgtgtgtatatatatatatacatgtatatgtatatatatatataaaatatcacataggtagatgatagatggatagatagatagatagatagatagatagatagatagatagagaaaaagtgtgtttaagctaacacactcagaaatagatgaaaacctagaaactagggtaaagattaacggctgaactgccatttatacttgctcaaggagataaaaatcagctttctccagtgaagggacactggatatatcaacctctcaagggtaggcctcatgttcagtagtagctgaccaacatataagagactccacagtttttttgtgtacttgcatttggttacagattttatttttctttttgaggtattgtttcattttgttttctcagtttacaatggttgttgtattaattttttttgttggtttgtttggtctttttttgaaggaacttaaatttgagtgggtgggtaggaaaggggaaaggatctggaaggatatacacaaaattaaaaagaactaatcctttaagaagataaataacgctaacaaaatgaatcaatgattttaaaagatacaaatacatatatgaagaaatatgagaaaggatactatagattatatgtatattaaataatagtaagagaaatttatgaatgtgccaatgaactcagcaatttaatgaagtaaatgaatgagttgaaagattcaaatataaaaatttatttagtacatagataacagaatactgttttatcaacaaattaaatccttattgaaaacattcctacaaagaaatatagattacacagaattttaagattttatcctcatatcaccttctagaagatataaaaaaggaatagtgccaagctcaatatatataaaaaagtaacaccttcatcaaaaaatgctacatttaaaatgaagaatatacagcaatatttttaatgagtatagatatatatctttggtcaattttttataaaatagcatctaacaatatgcagaaatatttatgattaaatcaaattaaccattgaatgaaatttgttttacaatttcaaaacaaatctatatttaaaaaatcactagacagtcaaggtaataaaaacattaggaatgtatccttccataaaattactatttacatgaatattcaaaataagccaggtatagggatgtacatgcaatctcagcactgagaaagccataaagcagataaatgtttatttcaagaccagcttgtacaacaagtaagaccttatctcaggcagaagtcaaaattaatatttggaattttgtaaattaaccaaagacttaacaaaattacaaagaacatttatgcaagaaaagtgtctggctctcagtttacaaaaagcagaatttgtgttacttttaacatgtctttatttcatactcctccctgagacactgtggtagcattgtaaatcagcaaaatagaagccatgagagaagaagcaaagatttgtacccccttcccatcctaatccccccaaaataactattttgacctgctaagcagttctgtagaaaaatatatcccatgatatttttagtaatttgggctgatgcagaggcttatgtgtgagtaaacccccataccagcattaagcataactaattaatataagttattgaataccatagaagataaactagttaacagtagctgagataaaaatttttaaaattatgaaactgtaaaaacaatctgtctggtaaagagaaattttgtggtataatcaggagttctgtggaaaatgttaccacactgcttttggtattgagtccacatcaatattcagagtgcatggtagcatatgaaacatatgaagtccctagttgcttacttcttaattatcactaggccctgtgtaagtagtaagttatggctaagaaacagttgtgaactacctgaataccacatgtgaaccaaaatacacatacagaacatcccttaaaaataatgagtgacatattgtttaaagttatttaaagaaatctctatctaatcattgcatgtgcttaaaatggaaaatacaattcagtatccacatacaacaacacacattctttatgaacaaaaataatgaaaaagaacagatcaaccgttaaaacaaactctaggaatgataaaacatattttcatgcatatacattatatgtaaaaatgtccagtttcaaaatatatattgtcttagttttggctttattcccatgtaaagataccatgactaagacaactcttataagggatatttaattggggttggcttacaattctagaggctcagtccattatcatcatgccaagaagcatggcagtgtcctggtgcagaagaaagagccaagaattctccatcttgaactgaaggcacagacaggaagaatgtctcttccacactgggaggagcttgagcaccagcagccctcaaagcctgcctacacaatgatatacttcttccaacaaggtaacacctattccaccaatgctgcatcccctaattttgccacttctatgggtcaagcatattcaaaccactatatgtgtgtatgtgtatgtgtgtgcatgtgtgtgtgtgtaagtataaaaataagagattaaaacacatgtacagaaaaagatatcaatagaaactggaaacaattcagatgccctcaaccaaagaatagatacagaaaatgtggtacatttacacaaaggaataccattcggctattaaaaactaggacattatgaatttcacaggcaaattgatggaaatagaaaatatcatcctgagtgaggtaacccagacccaaaaggacatccatggtatgtactcactgataggttaatattagccaattcgttcagaatatccacgatacaactcacagatccaaagaagttaaacaagaaagaaggcccaagtatgcttgaatcccctaaaaaggtgaaacaatgcagtaagagaggttagagggaaggagaaacctggctcagagaggggagtgtgaggggagtgaaggggggggcaggatcaggcaggaggacagacaggaaagaagcccagagggccaggagagtcagtgaaagtatgcagctgccaggtgttgaggttggaggattgtctaggaagtcccagagacctgggatgagggaacttcctgggaatcaatgcagacaaccttagctgaaatgccaaaaaaaggggaataggaaagctgatgagacaacatccagtagccaaacaggactcccagtggacggatagggacactaacacacccacaaaactttagatccaaaattggtcctatctaaaagaaacgcagggaaaaagatggaacagagactgaagtaatggccaactagtgactgacccattttgagatgcatcccatgagcaggcaccaatccctcatgctattaatgatgctatgctgttcttgcagacagatctgagaggctttacccatcagctgactgagacagatgcagatacccacaaaaacggaacagaggttggagaaccctatggatgatttaggggaagaattgaaggccctcagtgaggtggtagtcccatgggaagatcaacagtgtcaactaacctggacctttgggatctcccaaagacagcacaaagctcccaaaggcagctccaatcaaaaaagcacatacaggctgatctgaggcccttggcacatatgcagcaaagggctactatgtctggcctcagtgggagagaaaatgtctaatcttgtagagacttgatgcccgagggtggggcctgaaaagggagggctgctctctcagagatgtgggggaggggaaatggaggggaaactctacaagggggggggggagtccaggagagagagcagcatttgacatataaataaataaataaataaataaataaataaataaataaaagtattcttaaggaaagaaagatgttggacctactagacaaaggcagtaagtcaacttttaaaaatatattcaaagaactaaagaaaatgaggaaatatttacataatatatgaaaatgatgcttcaagaaatatagactaaaaaacagtaagaaatgaccacatgaaaattacttatgttaaaaaagtaagtgtgtaatgtgtatgtagtttaatgggagaaggcttgaccagcatattcaaagccctggcttccatctaacactgggaaaaaaccaacagaaatatacatgatataaagaactctcaataatgaatgtcagcagaccagatattggctaacatgaatatgctctaagtaagattatctagtcaaagtacgaaacagaaaggaaaaaaaatagctaaaatatagaaaaataaactaaacaaaatagagccatagcaaactgcatttatatcaacttatacattaatgtgagtccaagaaggaaaaagagaaaggggaaatttttaagaatgatggctcaaggggctggagagatggctcagagattaggagcactgactgctctggaaagaagtcctgagttcaattcccaccaaccacatggttgctcacaaccatctgtaacgggatctgatcccctcttatcaaagataacgacagtatactcatatagattaaataaatctaaaaaaaaaaggatggctcaaaactttccatatatatataaaaccaatgtaccaaacaagaatataaataagcttcaaataagataaattcaaatgcaatcatataattctaaagaacaaagcatagtagtgaaactattgaataattaataaaaagagaatgtgaagaatgtgtaaatatcaacaacacgctcttcatcataaactatgcagacgagcaggcaatataacatatattataatattacaatataccataatgaaacaatatttaacaatttaacatctatgaaaatacactcatattctcatcaataggtataatgtccagacaaaaataacagaaaaaattcaggtttgaactgcatcatcagcccaggatgaaatgaatggataagctgctgaggtctatcagataattaaagagtcattatcgccaatatctccaaaattattctctaaaatataaagttcatcaacagtaacataagttatgagtacagtattacattgatacaaaacttaaataaaaatacagtgaagaaaaaaatctataatgcaattgttctgaggagtatggatgtaaaaattcttaataaaaatgcttaaccaaatccaaatatacatcttaaaagatcacatactaatacaaaagttgcttcattccagagataaaaggataattcaacatatataaggcagtaaatgtaacaaacatgcacacatatgaaacatagatcaaaggacagaaattgcatgatcattgtaataaatacagaaaacagccttagaataatgaataactgttcatgagaaaatactccaagtaaactatttatggataaaaagacaataccttgatataataaaggccataaacataaaattatagcaaacgtcattctcaatgggaaaagaactgacagcatcacttacaaagttgggaaataagtatatctcgtctctccacttgtcaatataatgcttaaattattcacctaggtaataaagcaatggaaatacagggtacattaagtgaaataattcaatccattcctattacagacaatatggacctacactcactgggcactaaaattctcctcagacaggaaaaccaactgatctgataaatgctcctaggaaaatagcaagatataaagtcaacacaaaaaggtatgacaacaacttttctatatttgcataatgaacattctgagcataaaactggtcacatttacaggaatgtcaaaacataaccactagaaataaatctcaccaagaaggtaaatgatctcaacaatgaaaaccttaaaacacttccaaaagaattcaaagacacgtggtttgtaaattgttattttgggtattctgagtttctgggctaatattcacttatcagtgagtgcatatcatggatgttcttttatgattgggctatctcactcagaatgatatcctccagatccatccatttgcctaagaatttcataaatgtatcgtttttaatagctgagtagtacattttctgtatccattcctctgttgagggacatttaggttctttccagcttctggctattataaataaggctatgaatatagtggagcatgtgtccttatgacacgttggagcatcttctgggcgctcagtattactgggttctcaggtcctatgtccaattttctgagaaaccaccaaactaatgaaactcaagaacaaagaacaaagtgtggatactttaatccttcttagaagggggaacaaaacacccatgaagggacttacagagacaacatgtggagcagagactgagggaatgaccatacagagtcgcacctgaggatccatcccatatacagccaccaaactcagacactattgtggatgccaacaactgcttgctgacaggagcctgatatagctgtctcctgagaggctctgccagtacctgacaaatacaaaagtggatgctcacagccatccatgggaccgagcacagggtacccaatgaaggagctagagaaaggacccaaagagttgagggggtttgcagccccataggataaacaacaatattaattaaccagtactcccagagctcccagaaactaaaccaccaaccaaagagtacacatggtgggactcatggctccagctgcatatatagcagaggatgtcctagttggacatcaatgggagaagaggcccttggtcctgtgaaggctctatgccccagtgtaggggaatgtcagggccaggaagcaagagtgggtgggttggtgtaaagggggagcaggaaggtgagggggagggtgttttggaggggaaaacaggaaaggggataacacttgaaatgtaaataaagaaaatatccaataaagtcaaagtcaaaaaaaaaaaaaagaaagaaagaaagaaaagaaaagaaacgattaaaaaaaaaaaaaaagacaccggaagacagattggtagagttaataatgtaaacatagctctgcaaattaaagtgattcacattttcaatataatccctattacaattctggaaattgttggaagaattattttaaagtttaaaaacaacactgagtacaaaaacctatgaataaccaaagcaatcctaagcacaaacagcaaagttggtattgtcacagtatgtaacttcaaacatagtatagagccattctgataaaacaacatgatacttaacacaaaacagacacatgaacaaatatactaaattatactaaataaaacaaaacatataatcccatgctgttgtgcccaactatttttttgttttttttttttttacatgagtctcaaaattatacattcaggggaaaacatctttaataaatggtgctaagacaacttaacatatatgtacaagaattaaactagggctgaagagggcttagcagttaagaacattgagggctcttccagaagtaatcggttcaattcccagaacccatgtaacaactcacaaccatctgtaactccatttcccagggttcagatacctctgcaggcttccttgggaagccaggtagccaagtgatacacagatatacatggtcacaaaacactcatacatacaataataaaaaaattaaaaaaggataaactaaattcttctctcttaccctgcataaaaatccactgaaaacagattaaaggctttatttaataaaggctttatttaatgtatgacccaaagaattgaagtggactacatagaagcacttcaagatatagaaaggcaaggactttctgaaagtaggtcagaaaatgttaggaggaatttacaaaataggattagattacattaaaagtttctgcacagcaaaagagacaaagctgtagagattgctcagctgtttcagttacttactcacataagaactaagtttggctccacatggtagcacagttacctctaactccacttccaggcaatctgttgcccccagttctctgcgcacacatggtacacatagcctcataaaggctccagacataaaaaaaaaaacaaaaacaaaaacaaaaataaataaataaacttttaagagtaaagattcagactacacatggaagaaaatctatgctgttttatttttttatatctgagaggggactaataccaagaatatgcaaaatgctataattagattatgctacctgaacacattaagcagttaggaacattgagggctcttccaaagttaatcggttcgattcccagaacaattgtggttaaacattgaaaccacaagtaatatgaattttccataaagaaaaagagatctttactgataaagctcaagtgaccaataaatacatgaataatgatcagtatttttaaccattaaggaaatgcaaatgaaaagactggaaatttatcttatgcccatcagaaaggctacctctaaggaaataaactagactccttgtggagatggctcaggtagtatagtgtttttctttcaagcatgagaacctgagtttgaccaactaaactcaagtacaaagaagccaggcaaggtggcacaagcttgtaatgccactgtggtagaggctgagacaggtaggatctctgggactcactgttcagatagcataatctactattccaggtcagtgagaaactctatcacacaataaacaaaacaaaacaaaacaaaaacaaataagcaaacaggaacaaccatcacaaaacaaaaaacaagtgaatagaaacttaggaaagacttctagcctccatttgcacacacatggaaagcaacaacagaaaacactgaagaggatgggaggaaagaaggaccactatacatagctagtgacaatatgaattagttcagccatactaatcagtctgtatacaggtttctcaaaaaaaaaaaacaaaaacaaaaaacaaaaaaaacaaaaacaaaaaccgaaaattacaactaccatatgatggagtgatgccactcttgggaatgtaattcagtatagagatatgtgaacatccttgtccagtaaggaacaaattaaaatgtagatggtatgaattagttttgatgttcatgaacagattaatagacagctgggattttcttcatccataaagagtaaaatgatcacatttatgaaaaaaattcacaaacacaaagacacacacagactacacatacacacacacacatgaatggcatggaagtagggaaaagtattcaggaaaggcaaagagggtgagttgtaagaaagaagatcaataaaagatcataatgagtgggtgatgaatgtgattaaagtagaacatatactatcatgaaaatgcaatcgagcaactggagagatggctcagtggtttaaagcactcactactcttccagaggtccttagttcaattcgcaactaccacatgatggctcacaaccatctgtaataagattccatgccttcttctgatttgtctgaagacaactacagcatatatatatatgtatatacatatatatatatacatatatatatacgtgtgtgtgtgtgtgtatatatatatatgtatatatatatatatatatatatatatatatatatacatacagagagagagagagagagagagagagagagagagaataaaataaaaggaccaggagtcagaacagatttggggatgtaaacaaacaaatgaataaattaaaggataaataaaatgacataaagcccatcactttgtactagaaatatatgctattaaaacaaaaagaaatgatagcatctagctgcatattacatttctgtagtgaataactatagatggtgtgatttcttaaagtcagccacacattacacattagttgcatccaagatgctaaacatattagaattcgtgtaatttcaacttactgagtttaaactggttagtataaaagtcaaccatttcaatgaaagttactatattttatgtaaataccttttcataattaaaatctattgacacaattatggaaataaaattaaagcacttagcacaagctagcatatacacacactttccacttacatgtgtgataaggttaaacagtgagaacatcttgtctttgatttctgtttggaatgctactggttcttactctaatttattcaacaaatgtacatttatttaaatttccatttcttgtgtgacttttatcagagcaattgatcaaggaatgggtaggttattaagttggacacagaaatgatcattattattttaataaaaaccattgaatacatttaaagttataactacatccttacaaaatttatggatcttttctaagacccaggttttattttacatatttggtttcattgattactgttaataatagtttctttttttgttttttattagataatttctttatctacatttcaaatgttattccctttcctagtttcctctccggaaatccctaacccacccctcctgctccccaacccacccactcccattcccagtcctggcattcccctatagtgggcatagaaccttcacaggacctattgcctctccttccattgatggccaacaacccttgatactttcctactgttgccttctactaaggttgtgattttggtttttcattgtaatgtatggtgttgaaaagaagaaaaaaaatgagtcttgctcatttttatttacatttggtgtgactggatgttcaaaccagtggcactgaggtgtttctggttaaacaatgttggctaggatcatctaatactaattcttattgcttttgtgttgggataagttgtggggggtctcaatgttccctgtcacctccattgatataactatgataggaaatgaaaaaatcagttctcttcttggtaccacttgcaggtgatggaagttcatctggcacaagcctggcaaggaaagtgatatactatttttaccaatacatgtattttcctattccatgctgtcctttcttataaatcataaacatggaggggaaagtgttaccgttgctttgcagacactataaatatatttaatgtcacctaaaatagaaaataacttaggacacaagtagatattattagcagaatatgacatattgtacaagtactagtcagtatagtaagtaatgaaaaaaataacagacttgcaaatttgaaaaggaggaaagacatttattcatagatgacatgtttatctataaaaaactgaaaaccaaaacaagaaccctgagattcaactagaaattggatatctaacctataatcagagcactgaataggcttgtctcttgctaattatctttgagatacatcattctaagaagctacttgtttaactaggttacctgctaaagttttatttaaacaccatcaatgaacaaagactctttattctttttatcagtgacatcacttaagtacagacaatataatacttaataaagtaccaaatgcagagctcaattttggcctgttaggttaagtttatagataaacatataatactagtagaatgattatatatgtcttctaggaaatccttacctactgtttcccaaaattaagaaaatcataccatatcacaagattagacagttgacaagaaaaacatattcttatcaagaatattgtttatgagtgcttatttacttggacaaaaggtatagtaaatggcttctcatatgaaaattgaattggctatacaatacaaacataaaaatggtacttttctttttgaataagttagactgattttcactcaacctgtctaacttgagaacatttgacttactggcaaggggttccaaacgttagacaagatggcacaactttgttatctacaacattctcagttaagaactgtaacagagagagagaggagagagagagagagagagagagagagagagagagagagagagagagagagagagagagagagagagggagagagagggagggagggagggagggagggagagagagagagggagagagagagggagggagggagggagggagggagggagggagggagggagggagggagggagggagggagggagggagaaacacatcctaaaatctcatcatttaagtaaatttacaattttgtgttatgttgtatttatagcttttcttgcttcatgaagtcttcttaagcctacaagccacagtttgactatacctgaatagtttaaacctagtgttgccttgatggctttctatcctgataacctgtgcactctaaagtagtgtataaagatctaaggctttactgaaccttagatatctcacttctcatcgtttaataattgctttctacatttacacacaccaatattgggtggatatatttataattgttataaggtaacttctgtaatccattttaaacttccactattgtctccttgcctcccctttgaatttacagttcacattttaaagaatttcaaaacaccccttatttttcattgtatttattaggatagctttggccaggtcagggacatacatctttatttatagcacttgggatttaaaagaagaagttcagataaaccatgaatacataatgaaaccatgtcacaaaaaaaggaaaacattttccttgatgatattcacactaaagattgtcactaagcctcttactttattatttaaatttgggggtgttgagaatgaaatacaaagccttacatattctacacaagcagcctacctctgaactttgcatttggttctgtttccactgtaattaacaattttttgtaggactggagagcaaacctaggatttaatgcatccaaggtaagcactctactgctgtgccaaagaccctaccaatttaacattttacataaggcaggccacttttatcacattaacttttaggggaagagggagtggtctgttaagtctcatgtttctgaaggatagctctgttaagcatagtaattcttggttggcagcactacaaccatgtaataacataaatattaattcatttatggatgactgggacatagaagctctgacatattagtcaattaagcctaattgttggattaatctgaaggcattattgaaaaatggtagacagaacaataggtcaccaggttgttgtctgtagccatgtcttagacttttcatgtctcttcctggttcttgaccactatgaggtgaacagtcttgcttcatttatcatatcttctgccatgatgtcctgcacttgtaatcaacaaaagcaatggaagcagtagatcatggactaaaaccaccaataccatgagtcataacaactgtttcctctttttaaattgttcaagtattcatcaaagtagacagcagatgcaatttttttctttcatttctaaagttttctttttttttattagatattttacatttcaaatgctatcccgaaagttccctataccctcctcccaacctgctccccgatccacccactcccacttcttggccctggcattcccctgtactggggcatataaagtttgcaataccaaggggcctctcttcccagtgatggtcaactaggccatcttctgatacatatgcagctagagacacgagctctggttagttcatattgttgttccacctatagggttgcagagcccttcagctccttgggtgctgtctctaaaaattcaggtgacaacagatgctggtgaagatgtggagaaagaagaacactcctccattactggggggattgcaagcttgtacaaccactctggaagtaagtctggcgattcctcagaaaattggacatagtactaccagaagatccagcaatacctctcctgggcatacatatatccagatgcaattctttagccctttaaaaacttctctacttcaaagcatgatgtttctattgaggtgtatgctacatatacgagagggctcttatatatggtttcttttgttttcaacatttttctggtgtgtgtgtgtgtgtgtgtgtgtgtgtgtgtgtgtgtatgtgtgtgcgcgtgcatgcgcagaggcgcacatgtatacctatgtgtgtggcacaaggcaatgactatgttctggggcaaatacatagaccaaacctggaatcccgtgaactacctgtacctgggtaactttcacctagtataggatgtttaatgccattaattcttcagcctcttaaacctttctctttgttttatcttgaacacaaactatttgaacctttgtcctattgtaacattttgtgctattgattcaagccagggaattgggtaagcaaagcaaatgagccaacaccaagttaaaaaaaaaattcctttttaatcgtgctccaccaatgccacaaacttccttcattcattctttatttttctcttctttctatatattttcagataactaataatctaggtaagagtttttatttttgaccaatgtgttatttaattgatgttttcaggtctaatatttgttgctattgttccaatcttttaaccttccagtcatgtgttatttgttttgaatcctcaatcattatgtttgaatatcagttaaatttgcagtttggtaatctgatacatatttttattacattcgcctaattgctcagatacttcacacatttccagtttttccttattaactatttgttctttccccctatattataatgattttgagcactcttttgacccttgtaataatgacttagtgtgtactaaagtagatactcattccaagttttttcagtcttcctttggaaaatgcctgttcaaagaccctggacagagtgccacaacctttgagcccatgaccaacacagcctttgaaacactagggaattctctcactccaactctacactggctagcacaatgctggactagaatcctgtggctattgatacaggcagagatttgagaagcactcaaaacctagaggtactgatgctaaaacagcactaaaatatgcccaagttccattgccaccaagccccttgtagtcatccagtagtgtgtaagagaacacagaccaattccatctggcagttgctacatattcttatgtgatatgagtaaactgttgcagctcaaatcacaggagggtcttgcttcagaggtcatactattctgatcaataaaggtttttatgtcatgcctagttggtattggggtccatagtaaaacttacatgcttatttatccaattcattcactagctatcaaactgcatacatatacagttttgcttataaattagttggtggatattttgtatgtctttacatggtgactattttcaagagtgtggcttttaaaagttggtagaaagactgctggagaaatggctcagtggttaagagtgccaaccgttctgcgctggagagatggatcagtggttaagagcactgactgcccttccagaggttctgagttcaattctcagcaaccacatggtggctcataaccatctgtaataggatccagtgccctcttctggtatgtctggagacaactacaataaatacaccttttttaaaaagcacaaaaagaatttttaaaaaaatgtggaaagcttttgtttgaatacttcagttcatttggtgatatacttgctaggcaaataatcaagtcataccgattctctttagtttactgaggaaccaccaacttcttctttccatatcagcatgattttacactcatattagtcataaacattctatatttttccatacttaccaatatatttcatctttgaagagaaaggccatttagtgggcataataaagcatctgattttggatgtaatttgcactcaactaaggaatagtaaaggagagcatcctttcaagttcatgccactaagtatatgtatgctttagcatctaaccgtttagaagtttttgcttggttcattgttggactcgactgtttttgctgcagaattaccatgtgacacagctattccatacactggatctttatcagatgcctatgatttggttgaaccaaaaacctacttgctcttttagtctttatcttatacctgaaagttaattttaaaattgaagattacaaacattttgtgaagattgaggatattcataatacttaaaccttttgttcatttttagaaaaaatggtgatctatacttactcttttttaagtgaaaatacaattttatataaatacttttgtttatttactgtttggcatacaataaaaacattaaaatcatcgagcctggagatcagtttaattttaatattatatacaacaattctagctctgatcccacataccaatacataattatactcatatattatgcacacaacttatctataattgctacaagttttcttgaatcaatgaaaaacggtgaaaccccacgtacaggcagattattacctaatgacctttcctgttatttctatttattcgaactattgtctactgacttttgtttcagcttgacatactctacctgttataattacagaaaacgttttaagtggaaacagtagattctcaaactcatatcaaaatagtgggcttggttatcagtaatttgacacaaagtgaatgtttccttcttggagttatttaagctctttgttgaggtagggttttcatgtagccttggctggccataaacatatgtattcaaaaaagtccttgaacttcaatttttttctttcagttttgttaatggttacattatattcttttggagctttgatatttacagctttgtaaatactgttatgttgccttagtcagttgactaatccccacataatattccttgtttcctctaagtactaatttttaaagtctctacccctttcccaaacctgatatatatcttgctctctgccctaattcactttgtgttacatttgcatggaagggccctttttctcaatcttttactgccaacctgtttttttgtttttgttttcctggttacttctgctcttttaatttattgctcgtatatgtaaatgatcactgacaaatgtttgctttatatagtttggtccttgtgtgtctcttttttttcttttttttctttttttaatcttttactgtttggcttgcgatttcctccaatacagccattaatactcatctcttttttgggggacggagggtaatgtcacattttggctcgttgtttgcttttgtgtgtgttcttcagtattctttgtagaaaccatagggcattatatacattcttcctaatataaaaacaattttcattgaagtactgcataagggacaaatctaaacattgtataatttaaatttaagcatttaggaaatagtaattcaagttccaacacttgttttctaataccttttctttgctttgacattctaagagtgacaaaaaaagtataccttgtaactattcaaaatgatcaatgaaaggaagaaaacagttaagttgtaggcctaggaacatacagtaattaaccataatgaacaaagtacagatgaaatagatgaataagctaagtacagtagattcagtacttaggatcactgatgttttatatccagagaaccctacagtaatcatatccttctaaataatttttcacatggcttctatatgatacgatgatgcaaaaacatttgagctataaaggacttggaatcctttcagttttaattattgattctcacatctaaacttaaatttgaactgacagattaattgcaagaggcttcatagtggactactttatttcaaagtaccacaaattacacctttataaaatgtacatataacatgacttttgttaatttctaaaattcttcagaaatactgggtttaccaaccaaactgaatactgaggttgtttaatcttaaaccataacctgagtcgaaattgttccttccacattaatcttattctaattatttatttaaagcaggatcttactaagtagccctggccggccttaaacacaagagatcctcctgtttctgcttcccagtgctgagactaaagtcatgaactaacgctatctgtattctcttaaaaaaaaaaaaaaaagacctagtagtagtgatttctcaaaacttttacttaagaattcctcttaatattgctctcattctttttagaaacttccctggatataaaacctcagtgttagtgttctcatcctatacctccacccttcactctttctgcttctgtaccctcctttcagttcctcctcttaactttggacatcgaaaaaacaagctatccaatcatttaattggagacacatggatattagttgcttctttttgttgctttcaagattctgtctctggattttggtaagtctgattagaatggatcatgataattaccttttatggtttactctagactatactggatatcatatgcatgtacatttgtgcctcaaaaaaaaattgcactttttccagctattactccttgaacgttcactcttagggaaaatttggtgcaaatacaattagaataataaaatcatttaaaatgggaattttgctttctacagctctgtaaaggttatttttctgatagctccatagcatacaattgtctcaaaactattgttctaagggtcttgtacatcctaacgaagtgctttatcaatgaactataccaatgaattaaatcaattataccaatgaattaaatcaacaacccggataaccctacaatgacttgttttagggttcagattgtggtatgttatgacaaatgcttaaaacacatttttttttttaaattgtcatttcactgttgtgtgagatgctccatgtcacttacagtagttatccatggtgtccaagtaattatgggtttattgttgtcctactaatgactcaaagaggttattttaagatttgcaacttatgcaatgtagatatgtcgtttttcttgtagtcctgttatgaaaggttctagattcttccagtaatctaggactgctcttaagtatatagagaggtctgtcacctgttttcctaattttttagttagctgcatgtttgtctcaaagcgtatttgctattaacatgctcaacttttttgagaaaacactaagatttgtttccatcctttaaaaaatcatttttgatatgcatttaatatgtatttaatatgtcttatacattgaatagttaggcctttatacaaatccaactaaaattttctttgcaatgtagagtttatattataaagttttatcactttgttattctgttcattagcaccactatatattttcccgttgtttctgcttttatttaaattgagcattgtattagttccctaaggttgctgtattactgcaaactaagtgactaaatgacatagtgcaaaacaattcattgtgttaattctggagattaggcatggtaacattcaaacaaacaaacaaaagtattatcagggctttacctaaaacctgtatgagaatcactgtctcttccaggttctgatttttttcactttttaaaagtaatctttggtattcttcatcttgtagaaacaatgcccaatctcttgctccatattactcattttcttcctatttgtgtttgctctccttatatagtaaggacatcaggcaatactaaattacagcttattctaaagccacaagtctcaattaaatacaactggatagatacttccaattaagtacctcttcacaactgtcagatatggcaatctaaaatctatatgtatagtttaccaaacttaaaacttctggtaatcttcaaaattatttgtctctgactttcttcctgttaaggagctttgatttacacatgctacagaagaaagggccaagttgttgcttcgcttgttaccattatggtagctagaagttagcctttgccaacattccctgtaaaataggaacctgaggttaattgtcataagtacctaagagaaatacctgatcaacgtccaaattatatcttcatactctgacagctgagctgagtttaaaaaattatagtaccagtgtcttaccgggttgacaaaatgtttttaggcatttgttgagttttagatatgagactctcaaatttgagtggttatatattttcataagttctatcaaagctaattataacacaatttcaaagagttacaagaagctattgactcactagaaatcctgccagcattctgctcaccttcgttaggtatccctttccaggctcacctccattcctctctataccataaaacacagaaaggacaaagctcagattgcaataagacaaatgaattgccttctccattggctttttcatttccccttctgattttctaggacaatacatttattaatagttaaaagacaaggccagtgacatggtttagcatggaagtggacttgctgctatacctcacaatgtgtatttaaccccattagtcacacaatagagaaccaactcttgcaaaatagtctacatatgaaattccattaagaatgatatttgatatactacaagtggcagaaattttcggggatacactaataaaaagtgacaggagcacactgctagttttgtagagagcttgggacagtctgagatacagaagaggaatgggggaaagagtagggttctgggtaaattacacatggcgactatcagtggatcccacaaatgcgcactcgcacgtgcgtgcacacacatagtaacaattttaatgaacaaagtataaaatgctagtcctccactagaaatgactagtattgtatacaaggatatcttcccaattttttttttttttttgccataacagacatgtaactgaaatattaccttttatgacagaaagaaaaaaaaagagggaaaggaaaggggaaaggaaaggggaaaggggaaagaggaaaggggaaagaggaaaagggaaaggggaaaggggaaagagggaaggggaaagaggaaaggaaaaagcaaaggaaaagcaaaggaaaagcaaaggaaaagcaaaggaaaaaggaaaggaaaggaaaggaaaggaaaggaaaggaaaggaaaggaaaggaaaggaaaggaaaaaggaaaggaaaggaaaaaggaaaaaggaaaaaggaaaggaaaggaaaaagaaaaggagaggaaaggagaggaaaaaggaaaggaaaggaaaaaggaaaggagaggaaaagagaggaaaggagaggaaaggaaaaaggaaaggagaggaaaggagaggaaagtaaaaaggaaaggagaggaaaggaaaaaggaaaggagaggaaaggaaaaaggaaaggagaggaaaggaaaaaggaaagtaaaaaggaaaggagaggaaaggagaggaaaggagaggaaaggagaggaaagagggaagagggaagagggaagaggaaagaggaaagaggaaagaggaaagaggaaagaaagaggaaaggaaaggaaaggaaaggaaaggaaaggaaaggaaaggaaaggaaaggaaaggaaaagaaaactgagttcataccactaagctcatcactaaagaactggaagtttaaagtgttactagataactaaagagtcagcaaactacaggtttatgtcccctacaagtgctgttatatgtgacatacatgacaatttcagattgttcccattttattatttcctcttatgagttggttatgtagaaacagaaaaagcaaaaatggtagagatgaaaagcaaaaaacaaacaaacaaacaaacaaaaaccctaaaaccttacataaataatggtttacacatgcaaactaaagaacttggaagaataagttaaaagttgcatagtactgaacagatggtttaaagttacatataaaaacatgatggatttacccactatcatctaaggaatgagaaacaagctggttttccttctgttgctttcccatacaggtgtgcccctaaaaccagtagaggatttcgttttccctccacagtaggaaagtgtaaggagtatctgaatcggtagtaaagctgcatccaggatgagtcttcatacacacgaacaatctttgtaatgattttttttcttagctttttattgggtacttttgtagaaatttgcatgtatggtctggttggctacccaggatctttatctttgcaatcatttcatctatacattctttcgacagatgtattacagcctgggaattgaggattaaaaagaaaaaagtgaaagaaaagttgaaaccactcctactctaggacattatcaatgagaaattgaggcaataactaaagcacatacacaaatatatatataaatacagatgacctatatgaactatatctattcagagaaacacagcataaagatatattggtcccaaacactgtatttggtgttcttggtgggagtaggtaaaagatgcaagagttttggaaacatcttctaaaatacagttgcataataggctaacttctactactcaaaatgtacatcatctagttagaaactagaaccctctgcacaattttatcttgatctacttccatccatagctagctatgtctgtgtcaagaaacctttttcatttgaatcaacaaataaattggaggggatagggatgtagctcaaaaaagcacttgtctagtttatatgaggacctgtgctcttctctcacaagtctcctacccaaaataaaccaacttactactaagctctttcagatccactgagaaggatcaaacaactctattgaggcagagtaatggtaaattattttaagagttaatatttcaattatttgaaatattttgatttggctaactagatttcataaggtacatgtatatctggttatttaaaagctatgataattgatgataattgagactggaatggaaggcatttagctagtcatatgggagattgtaaggagaagaatggaaatgagactctaagacagtctgctcattgtatggttccaaaaagtatcttcatattttgatgtggatccgtaagtcacagttacaaattccctaaccttgcaaagcttggtatactgagtagaacacagggtcaaacaaaccaattcctttttgtcatttctctttaacatgaattctttgtatacctctcaaaggatagtaattccatagattctgtcctttgtcgtctcttttcatttcatcacagttccctgaaagtattctaggaaaatactaacgatgactgtcatgctagagccactcattttcatcttggtgaagatcctctctagacttacccttgaataatctcactacacaaagaatgtgacttagtacactgcaactcccctgcctcatctgtcccagggaaaacccaatggcatcattatccctccatcatccatatcaaatatgtgaaatcgttcacttgactctcctctatcccatacactatcccttctcttttatcatgctgaatctttctgcaactatagcaacaatctcattaatgcaaagaatagagacacttaggctttcccagttcatatggtaataaatgtataaatttatgtctttgcctcttaagatatgcaaagtaaaatctgaagtctacaagacccatcatgatctgtctggctgcccaatcacatccagctacttatctcaacccaatacggcccctgttaaaataaaatgctcttcttttctgcctggtaaccatctaatcctttaccacgtgtcatagtttttggatctgaattctcagtctgctttgttgcatgatgcagattttatgcatgtgtagtacaggtggggtgtagaacaagtcgttcattttaaacacgatctctggatttttctagcagtgagacctcaagctttgagatttttctgttcataaacttttttttaattttacaaatactaaacagcatagagctgacagcagtgaaacattaaaatgaccaactcttaattgaagacgaaagtcttcctcctgctcaggtcctcctaccgcaactcaaaagaccctccctactcattttaacaggtactgagggaacttctgcactataggaacttattacaaagatattgtcttacttatcaagttcttaggattaatgcaagtggtagtgaggattggtgtattaataactttatttcagaatttaccttcttggcaatcccaacttgcttggctgttagtttccaatgcctcctacgctgtaagcgtctttattggatgacactcagcttccaattgtatggcttactaaggaaggaaacttctatagggcaattttcaaaacagctgatggctaatactttataataatgatatatgtatggctcatgagaagcacctacctgaactcaagactggtgttaactgcattttattctactgtcaaatggcactttagacatgtcttaccttggaatcctttcaagagtcaattacctctcccatgtcatccagaatctaaagaccacagaataactttcaaagtatattatttcaaacacacctcactggatttaagaacagttggaaagctccaggcatatttggagaccagtatcagtaataccctgataacaaccagacaaagataacaagaaaactacaggccagtatcttttatgaatacaggtgcaaatatgctaaacaaaatactagcaaaccaaatccagcagcatagaaaatggtttatgtagcatagacaagtggggtaattccaggaatgcaaggttctttcaatacaaaattccatcaatgtaatacaacatatcaatagaataaaggacaaaactacatgacaaccttattagatacagaagaagcatttgacaaaattcaaaacccttttcttgatttaaaaaaagactcagtaaggtaggaatagatggaatatttctcaacttgcaacatctatgaaaatcccacagctaacatcatatttaatggtgaaagacctaatgcttttccactacaatcagaaacaagaaaaagatgtacactcttgccacttcaatttaatatcatattggacgtgctagccagggcacttaggcagggaaatcaaataaaaagaatccagattggagaggaaacaaaagtatttatattcagagatgcacaatcttgtataaaaaattaaaaacagaatcagctcagaatagctacagtatataaggttaatacataaaaatgaattctttctagatgtagcaatgagtaatccaaacaaatattaaaaaaaaagttgtttgtaaaaggatcaagtgaaaaacatttaactcaaaaaagccaagatgtatacactgaaatctataaaatagcattgaaagaaattacacacctaaataaatggaaagacactccatatttatggattataaaatttaatactgttaaaataccaacatacgtcaatctgatgtatcgattcaacacaagaacaatcaaaatcacaggtgctttttatgtagaaattaacaaatagattctaaaatccatgtggaatgcaagggacccagaacaggtaaaattatcttgatgtagaacaaagctagagaactaacacatcctaaattcaaaacttactctagggctacagtaattaagacagtatggtactggcataggaagagacacacataggacaatgggacaaagttcaagaatccaaaattagccatatttatggtcatttgtacgtgtttttgacaaagatagcaagcctactcataaggaaattactaatagtctttgtaacaattaggtattgttctactagatatccacatattagagaatgaaactggatccctaaaatgtaccacatgcaaaaatgaatcaaagacctaaatttaagaaccaaaaccataagatacttaaaagacagtaggagaaatgaaaacatgtacacaaagtgttcatagttgtattcataatatgcaaaaagcagaaagaacacatgtatgcacaaccaagtggacaagcaaaaaaatacagcatatcaatacaatgacaatattcagccacaaaagaaacagtaccagtacatgctacaacattgatgcagtttgaactcattgctttgtggaaggtggcgaaacagacaaaaaggccacataattgtatgactccattaacatgaaatgaccaaaataggcaaattcataggcatacgaagacgagtagttgccaggggttggagttaagaacaggcagtcactcttaatgggtacagaaaactttttacagcgatgaaatgctctggaattttataaagacaatttcacaactctgtgaatatactataaccacaaattttacactttttaaaatggcgaatttttatactatgtgaattatatctaaaagatgtgagaaaacacatctcttccatttaaaggtggacgatataaggtcaggttttagaaaataagtcttcattacagacatttctaatctctctctctctttttttaagttaacaagcaacgttgggagaactgttctcaggatgtcttccaagatgttatctaccagctgcatggtaatttcactgaaaccacacaaccagagataaggtaggagtgggtataatccaagtcaagggaatggcagtgccaaactaaaattcagagtcatttgactgaaggctacaaccccaaccagtgtgtactatattccagatacattccttatcattttctatgtgtttctgggtaatgaaaaatcataataatgatccaaggttccatgcatgtcagcataataatcttaatttgttgtttaatttagtcatgtttgtttttgcaaaaaggaagatgacaaattttaggtggtcatgtggacgcaaccttaccatttgtcatcccttttcctgcctgtatgacttttagtaaggtgtataacctctcaagttacagatatttattggctttgtgaaaatgaaggaccatgtgcacagatctttagcagtcattgaaaattcttgtcagaatttacaggaatttgagcagcaaagtataagaaaatgttaaatatgactcacatatatttacagagaacagcatctggaggattcctctatgaaaatttgagagactagtcagtaataacagaacgaattaaggtatcagttgccatgactgctggaagagtatgagtggcataaagacggtggtcaagagtacaccagaagacaggatgtagagttacaaaactgtcttgctttcaaccatctagtcttttccaacttactgtcttttttaccctggggcagatataatacagtgattccagaaactctattcaataaatgtatgtgtatatttcttgattaatgcttatctgcctactgcctaagagacagaaagatcagtacaaggtagtttccactgtgaatttactcagattccatacaaaagagaagatgctttaaaaaaaataataataatagtgggacaatatcaaagctaaaacacaggaaagaaggaagggaacgcacttctgaaggcctcctcaactgttcaaataaatatgatccaccaggctgtgaccagggatatgtaggctgctattacactatgaaggcacactgtaactaatagaagtctttatgagtatgatactttcaaaattccaactgaaagaatatgtgagttgtataaagttaatctaaaaaggaattttgagtagtgatgaaagggatgctgaacaggatgcactagtaaattatgcagaaatccacctgtacaaactattcaaaggggaagtactcatacaaatcagaaaaaaaaatgctttttgagaatgaaaagaattagaagtagttcagagtcaggaagataacctgagtaaatcaaaggattggggcctgaaataaagtacaattaaataggtctgagagacaataactgacaacatgcatatatatgcacataaactgtgagagggtaggaaacagcaaaagctatggtaaacatggaaaggccaggaaacaactttgtggagttgctctttccttccatgtttatgtggagtctaggcagagtcttcaggtcaagttttatatagtgagcacctttacccactaagccatctccccaggccaaaaaattgacagttctaaaggaagtaacaagaaataactaggagatacaagagtaagaattttgtttttatcggtactgttttgtactatataatgacttagaggtaccaggatgatgtcctggaaacacgggtctgatatgatatgagatatgagacccacaaaatatgaggcaagagaaaaaactttgggttgaacaggaagttcagaggagtacttctaagtacaatcaggagagtatccatacaaggtgtctatgagttgggatggaaaagtgagcctttcaggaagctgtagcccaactctgcaaggctctcaagggttaaaaacaagacttctttactgtggcaaatggagactactagtattattgcaagtacattttcagtgaaatattcctggattagcagcctttacatagtgaaatgcagtacatacatgcactcaaatattcttacaactgttaccaaagtcaattttcttatttgaaagtagaagaggggaaaaaaaaagggcctctgtctatattgtgtaaacatttttcctaccaaacaccaggaactgttttacactctaaagatgaaagaagcagcaaatggaagttactattattattattattattattattttattctgggaagggtagaaaggattaaaatagaccctgggataagcagttaaagaatgaacatcttaaagagtagcctcagtaaaacacttctttctctagggtatgtggattcttgagaaaaaaattctttaaaagaggttgatttcagcaatagccaccttatggaaacacggagtaatgctgcctagttgatgcatttgccacatgttaatgtgaacaagttctctgaaggctcatttataggtttcttttgatatatacattcctacacaggatgtatttccaaataaaggtaaggttattgcaaatgaatttgatcacacaattaactatagaccacgatatgtacactcaatttgtttgctgcagctgccaagtttccagagaagttttgctgcaggctgtgcttttatgccataagtttgaaatgttctacactactaaaaggtattttttaactcgtaagtattgttccatgacaatctagtaaagcaatcatgaaaaggcagccatattaatgtggtaacatgccgagaaaaactgattaggaagcaagtgagagtttttttttttacctctgaaaactttttaggatttttttttcactttcttttaaatatattgatgttacttctgtttgataatctatattatcatttgaaaactttcacacagatatagtatcacaactacttcaatactgtagtgacaataaactgaagaacacaaatctcttcatgaatttattttataaaatatacccacttaatttgtcttcttatcactttcataatacataagaagcacagtggacaagatgcccattaagatgactatagtcacatttagggggtcctataatcaaggtagcatacataccacaacagtgttctaaaggctagctcagaaaaaaaaaaaagaaaacaaaacaaaacaaaaaaacctcacgttaccttatcacaatatggaacgcactgtgttctcttttcccattaaaatatttaagccactgtttcatttagcattacagtaaataagagctctgtctcaactactacaagaaagaaaataatcctaagacatccttttccccttccaatgatttgaaagctaccattatcccctgccaattaaaatcatcaggttgatttgcactagttgttaaaacaatcaaggcacaagctcaacaggttatctgtagcttgtagtaaaatgatataccagtatgtctctccttagttaaaaatacataattcttttattttgttatgcaacaaaagaaattaacatcacagacatagaagactagggatgggaaactacattaaatatccagtaatttaagcctatttgtactttaatataggacatgaaatctttaacacctttgaagtaaattttaatttgggggatatacaatttatttctcaggagtactagttccattcatttccaggcctgctaactgtgtaaataagtaacacaaggcacagtagctgtactttctgttatgctgcaacactgatcgagtgccttgaaaaatggttgattaaacaagatgacggcaacagaaggggagactttggattgtctattaaaatctcagcaataataaagattcattttaagtgcacttttacatgcttatttatacaacaaacttcctaattttgttgcaataggcttgactatcctatcatttggccagatgcactttccccagtaaacttaaacaacaaaaacaacaacaacaacaaaaacaacaacaacaacaacaacaacaaaaacaaaaaaaaaatccctgtcctttcatatactaagaggattggctactgaaacagttcattgcaagacacatgaagacaacatactgtggcatgagttgttttaatttgttgtgctgttactaaagttctgagggctgtggttcaaacattccaagttctcccttccatctttattggttctcaaaattttgtacagaaaactctttgggggctagaacagcagtacttgcaccacactgtttccttgacttcaagtttcaaaagcaaattgttagaaaaaagttcctgatttgacttagatacagggacaaaaaatagcacatacttgaagattacatgttctacaaatggtggcaatgttttccttgcgagaatagtttcgttggtatatatatcttaaatactcaaaaaggctcaacctcaagcagtaataaacacaagcaaaagtgatttaacccttaaaataaatattcagaaaacctctctgtacatacaagtgaaagaatatgtaacactttcacgcaaaaaaataattataataataataaaggatttgttcatatatgcagctgaaatctgctgttccagcccacaatgtccccaatgaagaagggaggcacagacatagatgactactgtggttcactatcttacagcctttttgtactgggatactattaccatcaaattatccctcttatatttattttttaactttttctttttctttttctttttctttttgtttacagcatgccaaatcctttggcatatgtgatggccttcaacaatctctctttaagtttttctttgcttgaatattccggaagtaaaaggacattaaagcaagtatgagatgtaggtaacctaaataaagagaaagggaaaaacaggacaatcatgagtcattggaaatatgctcagtgttaaatgctcctattagatacatatcttgttaggacggtttttaatgagaaactacagattaaatatatcataaacattgtactgtttagttaaaaagatcagttgggtctttatcctatgaaataatgcaaaaattaaagtgatgctgatgatagtaacatttattatctattgagtttccactctgttacctattgctttagatactttaacactgaagttcatttaaatctttacacaacaaacatcttactaaacccattaaaagctgaagtcactaaacaacttacaccaaagattaaaaattattcaaacctggcttttaaagattttgaagtctatgctctgtatatagatttgaaatactgctggcaaaatgaaaatgataatgattgattataaattaattaaaattagagccaagatgtataaaatgtctaattaacagtaataaaaatatatctgtcgatgtatatcgaagtctacctaggacatattgttcagccccaccataaaattgtgaagtatttattggagaaagaatacaatcaaaagtcagaatgatttaaccctagaataagaatctagtataatgtaaaagaacagacaatcctctaaattttagtgtagccattcaaagtagactgttctataataaggctttcttaataaactatgaaacaaagggggaataaaacataacaacttgataacgtctgtacttctgtaagctccataattactttttaactacactaatttttaaaaaaattcctcaaatcatgaagggaaaatatccattccactagtgtttgctgacttagatatttcaatataacatcagaagagtatatagaggctacatgttggctctgcttgcgtgtatggaatatggtgaaaaggtttacagtgggtacaaagttggagtttgatattacctttctgtgtctgggccatttttggctataatcatcttcaattttcctagtcctccaacaggtgctctgtctgtgcctgttgtaaactgcagaaagagtcttttctgttcatctgtaaacgaatgaacaatttcccagaactccctaatgtgaaaagagaatactggttttaatttgacatccactataaacaagatcatagtactacaacattaaggccaatgtcacagtgaatattaaaagtaccatttacacttagtatgtaagttttagtcagccagattttatatcttgtaggaactatatatgggataaatattaataactcttttgctcagtaattctacttaaaaagtacttttgtattcctaatgctaagcgtgatgttttaaaatttacttttgtaaaaaatacatgttcaatatcctattcacatttctaaaacctcaatctaaaaatctatcaagatcttctccaaagcaagagaaatgtgcaataaatatatctgtaatctatgctgagaataaaattggaaaatcaagtaataaatccccaaagtaaaagtagagagaaataatacacaagataagcacagttaaggatcagaataggacaaaaaaattgtagacactggaagagcggaagaaagaagtgacgaaactttccaaagatgatagaaatacctggtgaagggattttaatttttaaaaaattgtaagtgaaaagtagaaggcattgaatcacataaagcagaaccaaatattaaagaaacagcagtaaaaggttttccttcattgagaaaccacttaaagtgactgtactatgctttgctaccccatgacatttactaagagcaggtccatgggaggaaatatataaaaaagtaaatgataaaaaataaatttaagtccaataggaatattatgaagagttcttcaaatgagaaataaggctttttggaatatgaaactatttttaaaaaagactgagtcgtgaataatataaactctaacatgaaaagtttaacgatggcatcatgaatcaaaaataaagagattaatgaattcaaacagaaataataacacttgaaaatactgaggcaggttggtgagatggctcagcaggtaggagcacagactgctcttctgaaggtcctgagttcaaagtcccagcaacctcatggtggctcacaaccatccgtaatgagatgatccctcttctggcgagtctgaagacagctacagtgtacttatgtattataataaataaatcttttgggccagagtaagcagagtgaccggagcgagcagaggtcctaaaacttcaattcccaacaaccatgcgaaggctcacaaccatctgttcagctacagtgtacccatatacataaaataaataaataattcttaaaaagaaaaaagaaaattctgaggcaaatgcacatcaactctagaaataaaagatgattcaaaaatgaggtaagtaaatgagggaagtgtagtaatttgtatttgacaaacatccaacatttctacttgacaacagtctagaaacaaaaagcaagcaaagggttaggaagtcagaaggggaaaggagttaaaacaaaatattcaaaactgaagaaatgcatatcaaagtaaaatggaaacaaattgttaattgactaaaacctttcacttggtaaaaaaccctaacaagtaaagataaatgacattaatgtagagaaaatactgtaaattactccagagacaaatgtctctcatgtacaagaaaaggcaaagggaaaggaaatctaaaaagtattcctatgattcagcattttgaaggttgaggcaaaaggtaggcaagttctaggctaggctatgctacaagcaagctattgttcaaaagaagggtgtgagggggatcaataactgaacaataaaatgagtaagagacaatattaaaaatatgattaggtaatataatgaccttgaaaatagaaaactatacttcaatattatgtgacagctggaagagagcaaaaaagttgcaaagtaacctctatgttaataagggattattttgataatatacttaaaagattctttctaggtttgttccttgacaaggccttaccagtcataacattaaatagtaagtcttattcctggatgcagttttctaataatttcttttaacaatgttttcttacagggtaggggataatgttcaagataaggcaaaatttcaaattttaacaaagtcatgtgtcatgttaaagatacaccaacaccaagcaaagtcctaagcaaggctaaagtcctaatggtaaaacacatttactacattaaaagtaaattcatgagttcataatatctgaaaacaaaaaaattaccatattatctcttcagtatcaatcttaaatatatttgactttgtcttttcaatagattgatatcttaaggtaacaatataatagttgatatgaaaaagataggaaaataggagaatgacatatgtcagatgactagataaaattatttccttaaatcaccatttttataatcacaggtgaaatcatcaattaaggaaagacaaaaaagatatacaaggcaaaggactattgatcacagcaattttgttactgctccacaatctctgtaaacagagcaaatttagataggaaaatgagaggtcaacaattatgttttgtttattttagtcttctgaaaaggagacagaattatttctctttttaaaaaaatgaggagggagttagaggaacataaatcagcaagcagtgctgcaatggatcctgctccaagtttccttaatgatggatggattatgaactggatgggtataaaaatgtacaaagccgggctggagagatggctcagcgattaagagcactgactacacttccaaaggtcctgagttcaaatcccacaaatcacacaaccatgagccaccatgtaaaggaatgtgatgccctcttctgatgtgtctgaagagaacataaaaatgtacaaagcctcaaatgacatagagaaagtatgaatatttcacaaaagaaatgtttctcctcataataagcaagagactcttctaagaacaaaaagattcagtcttgaaggtgactaaaatggagaaagaaaatcagaaaaaaactcaaaagaaccgaggaggaatgaccatgtagaaatgagcagaatgtgcttttacaaaaaaaaaaaaaaaaaaaaaagaaagaaagaaaagaaaattggacctgagcaaattaagaatataatacacgagccaggcgtggtggtgcacgcctttaatcccagcacttgggaggcagatgcaggcagatttctgagttcgaggccagcctggtctacccagcacagccagggatacacagagaaaccctgtcttgaaaagcaacaaacaaacaaacaaacaaaagaatataatacacggactgaagaaccattgcaacaaggacaggaatattgactcaaggttaagaagaaacatgacatttaaagcaatgtgtacttttaaagaagctagggaagaacaatctctaaacagagtcaactataactactaactccagagattaccagatggcgaaaggtaaacggaggaatcttactaacaggaaccaagaccactcaccatcaccagaacccagcacacccacttcgcccagtccagggaaccccaacacacctgagaacctagacctagatttaaaagcatatctcatgatgatggtagaggacatcaagaaggactttaataaatcacttaaagaaatacaggagaacactgctaaagagttacaagtccttaaagaaaaacaggaaaacacaatcaaacaggtagaagtccttacagaaaaagaggaaaaaacatacaaacaggtgatggaaatgaacaaaaccatactagacctaaaaagggaagtagacacaataaagaaaactcaaagcgaggcaacactagagatagaaaccctaggaaagaaatctggaaccatagatttgagcatcagcaacagaatacaagagatggaagagagaatctcaggtgcagaagattccatagagaacattggcacaacaatcaaagaaaatggaaaatgcaaaaagatcctaactcaaaatatccaggaaatccaggacacaataagaagaccaaacgtacggataataggagtggatgagaatgaagattttcaactcaaaggtccagcaaacatcttcaacaaaattattgaagaaaacttcccaaatctaaagaatgagatgcatatgaacatacaagaagcctacagaactccaaatagactggaccagaaaagaaattcctcccgacacataataatcagaacatcaaatgcactaaataaagatagaatactaaaagcagtaagggaaaaaggtcaagtaacatataaaggcaagcctatcagaattacaccagatttttcaccagagactatgaaagccagaagagcctggacagatgttatacagacactaagagaacacaaactgcagcccaggctactatacccagccaaactctcaattatcatagagggagaaaccaaagtattccacgacaaaaccaaattcacgcgttatctctccacgaatccagcccttcaaaggataataacagaaaaaaaccaatacaagaacgggaacaacgccctagaaaaaacaagaaggtaatccctcaacaaacctaaaagaagacagccacaagaacagaatgccacctttaacaactaaaataacaggaagcaacaattacttttccttaatatctcttaacatcaatggtctcaactcgccaataaaaagacatagactaacaaactggctacacaaacaagacccaacattttgctgcttacaggaaactcatctcagagaaaaagatagacactacctcagaatgaaaggctggaaaacaattttccaagcaaatggtatgaagaaacaagcaggagtagccatcctaatatctgataagattgacttccaacccaaagtcatcaaaaaagacaaggagggacacttcattctcatcaaaggtaaaatcctccaagaggaactctcaattctgaatatctatgctccaaatacaagagcagccacattcactaaagaaactttagtaaagctcaaagcacacattgcacctcacacaataatagtgggagacttcaacacaccactttcaccaatggacagatcatggaaacagaaactaaacagggacacactgaaactaacagaagtgatgaaacaaatggatctgacagatatctacagaacattttatcctaaaacaaaaggatataccttcttctcagcacctcatggtaccttctccaaaattgaccacataataggtcacaaatcaggcctcaacagattcaaaaatattgaaattgtcccatgtatcctatcagatcaccatgcactaaggctgatcttcaataacaaaataaataacagaaagccaacattcacatggaaactgaacaacactcttctcaatgataccttggtcaaggaaggaataaagaaagaaattaaagactttttagagtttaatgacaatgaagccacaacgtacccaaacctttgggacacaatgaaagcatttctaagagggaaactcatagctatgagtgccttcaagaaaaaacgggagagagcacatactagcagcttgacaacacatctaaaagctctagaaaaaaaggaagcaaattcacccaagaggagtagacggcaggaaataatcaaactcaggggtgaaatcaaccaagtggaaacaagaagaactattcaaagaattaaccaaacgaggagttggttctttgagaaaatcaacaagatagataaacccttagctagactcactaaagggcacagggacaaaatcctaattaacaaaatcagaaatgaaaagggagacataacaacagatcctgaagaaatccaaaacaccatcagatccttctacaaaaggctatactcaacaaaactggaaaacctggacgaaatggacaaatttctggacagataccaggtaccaaagttgaatcaggatcaagttgaccttctaaacagtcccatatcccctaaagaaatagaagcagttattaatagtctcccagccaaaaaaagcccaggaccagacgggtttagtgcagagttctatcagaccttcaaagaagatctaactccagttctgcacaaactttttcacaagatagaagtagaaggtattctacccaactcattttatgaagccactattactctgatacctaaaccacagaaagatccaacaaagatagagaacttcagaccaatttctcttatgaacatcgatgcaaaaattcttaataaaattctcgctaaccgaatccaagaacacattaaagcaatcatccatcctgaccaagtaggttttattccagggatgcagggatggtttaatatacgaaaatccatcaatgtaatccattatataaacaaactcaaagacaaaaaccacatgatcatctcgttagatgcagaaaaagcatttgacaagatccaacacccattcatgataaaagttctggaaagatcaggaattcaaggccaatacctaaacatgataaaagcaatctacagcaaaccagtagccaacatcaaagtaaatggagagaagctggaagcaatcccactaaaatcagggactagacaaggctgcccactgtctccctaccttttcaacatagtacttgaagtattagccagagcaattcgacaacaaaaggagatcaaggggatacaaattggaaaagaggaagtcaaaatatcactttttgcagatgatatgatagtatatataagtgaccctaaaaattccaccagagaactcctaaacctgataaacagcttcggtgaagtagctggatataaaattaactcaaacaagtcaatggcctttctctacacaaagaataaacaggctgagaaagaaattagggaaacaacacccttctcaatagccacaaataatataaaatatctcggcgtgactctaacgaaggaagtgaaagatctgtatgataaaaacttcaagtccctgaagaaagaaattaaagaagatctcagaagatggaaagatctcccatgctcatggattggcaggaccaacattgtaaaaatggctatctagccaaaagcaatctacagattcaatgcaatccccattaaaattccaactcaattcttcaacgaattagaaggagcaatttgcaaattcatctggaataacaaaaaaccgaggatagcaaaaactcttctcaaggataaaagaacctctggtggaatcaccatgcctgacctaaagctttactacagagcaattgtgataaaaactgcatggtactggtatagagacagacaagtggaccaatggaatagaattgaagacccagaaatgaacccacacacctatggtcacttgatcttcgacaagggagccaaaaccatccagtggaagaaagacagcattttcaacaattggtgctggcacaactggttgttatcatgtagaagaatgcgaatcgatccatacttatctccttgtactaaggtcaaatctaagtggatcaaggaacttcacataaaaccagagacactgaaacttatagaggagaaagtggggaaaagccttgaagatatgggcacaggggaaaaattcctgaacagaacagcaatggcttgtactgtaagatcgagaattgacaaatgggacctaatgaaactccaaagtttctgcaaggcaaaagacactgtctataagacaaaaagaccaccaacagactgggaaaggatctttacctatcctaaatcagataggggactaatatccaacatatataaagaactcaagaaggtggacctcagaaaatcaaataacccccttaaaaaatggggctcagaactgaacaaagaattctcacctgaggaataccaaatggcagagaagcacctgaaaaaatgttcaacatccttaatcatcagggaaatgcaaatcaaaacaaccctgagattccacctcacaccagtgagaatggctaagatcaaaaattcaggtgacagcagatgctggcgaggatgtggagaaagaggaacactcctccattgttggtgggattgcaggcttgtacaaccactctggaaatcagtctggcggttcctcagaaaattggacatagtactaccggaggatccagcaatacctctcctgggcatatatccagaagaagccccaactggtaagaaggacacatgctccactatgttcatagcagccttatttataatagccagaaactggaaagaacccagatgcccctcaacagaggaatggatacagaaaatgtggtacatctacacaatggagtactactcagctattaaaaagaatgaatttatgaaattcctagccaaatggatggacctggagagcatcatcctgagtgaggtaacacaatcacaaaggaactcacacaatatgtactcactgataagtggatactagcccaaaacctaggatacccacgatataagatacaatttcctaaacacatgaaactcaagaaaaatgaagactgaagtgtggacactatgcccctccttagaagtgggaacaaaacacccatggaaggagttacagaaacaaagtatggagctgagatgaaaggatggaccatgtagagactgccatatccagggatccaccccataatcagcttccaaatgctgacaccattgcatacactagcaagattttactgaaaggacccagatgtagctgtctcttgtgagactatgccggggcctagcaaacacagaagtggatgctcacagtcagctaatggatggatcacagggctcccaatggaggagctagagaaagtacccaaggagctaaagggatcttcaaccctataggtggaacaacattatgaactaaccagtacccctgagctcttgactctagctgcatatgtatcaaaagatggcctagtcggccatcactggaaagagaggcccattggacacgcagactttgtgtgccccggtacaggggaacgccagggccaaagggggggagtgggtgggtaggggagtgggggtgggtgggtaagggggacttttggtaaagcattggaaatgtaaatgagctaaatacctaataaaaaatggaaaaaaaaaaaaaataaagaagctaggacaaaaactaagacaaaaaatagtaaaaaagaaagaaaatgaaaacctttgaattgaacagagaatatgaagaattaatcacattaaataatggtgattttattcacactgataattaaaaaaattttttgaaagaaaaaaaaaacaacagttcgttgaaaaagaaatgcaaaaaagaacagcaaaaaggacagctaatagaccttgaaacaaaaacaaaaaacaaacaaaacaaaaacaaaaaaaaaagcggaaaactttcatatagcaatggttccagagcatgccaggaaaagaaaaattaggctccatttactgataaaagtgaacatgaaaacctatttgaatgaatagttaaaaaggggatatggcacaaagaactgaagaacaagagttatttccaataaacttaacttgaactaaaaaagaactgaagtagcactacaaaagatgaggagaaagaagggcagtagcattatgaattactaccctatgaaagatgaagagcaaaccaaaccaggagctaagtagttcaacaagccattataaaaatatccaccaactattcaagtgccccacttagatttaaagtaacaggagatttgaagcccgaaattacaaggtgattggtgggagaaataatgcggggaggagaatttggaggagattgaaagaagcttattggaatttaccagaaaatggaggaaggtgtgtgtgtgtaaaccaaacaaaaacaaatgttacctagttggttaatagctcaatttttactatagaaagtaagaactaattgatccctgatcttttaatctattaacatgttttctcccaggcatggaacaaatcatttttctcttttgtagcacacagcagcaggtcttctttcctttctccctgttacttaaagtttcttagtatagacatctattctgtaaagtggcaaaaaaaaagggggggggggaccagaggtaacacttctttttttgctttgttttgttctgttttcttatgttggcttatttcctctttatagaagaggaactaaagaacattcttctacaaatgaaaatgataatcactatgttgcgtagaagttttgtttgtcaaggatgcaaaatttatttctcttgtcaaaacctaaaatagactgtggattttccacgtttatagcaattgaaatatatatattttgaatgaataattacttgagcttttacatcaaaaattattctaacataaaatacaatgtatttggaactgttccctttgaatggccgatttttaatagtagtactatgtaattttgattgttatagtttcaaagtctttctgaagaagatatagtgatgaagtggtctatcattcttttcatgggaaagaagcatggataagaacaacaacaaaacaaaaaaagccaaggaaagattttatttttaaaaacacgtataatatataatacttacaaatatatgatatgaccctgatggatacattataaaaaaaactgtatctgtactgcatgtagaagccaagattttcaacataataaggcctcaagatctaagagaattagacataggcaaaactgacacaacttttcatttaaaattttagaagtagggctggaacttattcggtggctaaaagcaccagctactattgcagaggatccaggctggattcacaacccctatatgatggctcaattccagtgtcagggaatccaactccatcctctagcctcagtgaacactgcatacacacattgcatagactcaagtatgcaggccactcatacaaaaaaaaaataaaatcaaatcaaaaaccaaagaattgttatttttaaaagtatttaattacctattttctattgttgagttgtttcgtattttaattaactgaaagaattttattttacagtataaacatatagtaatgttattttaaaaaataagaaacaaaaataggaatcaaaataaaacacacaattttattaaatagtataatcatgaaaactttgtcaatatcaacaaaagatgaaaactataaagacaagaaaattagaaatacatagtaaaaactaaaattctaaaataaaggctatgaaaacaataactagatcagaaatgaagtttagaaaaccttaacagagaggaaccttgaaaaaatgtgacagaaataaggttcaattagaaataaattttaaaaattataacaaatacaaagaaactagagataaattcaaaactatacacaactaggaatatagacaattttacaatcttttacaaacctaaaatagaaagattaaaactatgaagattcaaaaagcaattaagttgcaccatggttcaaatatacagtattaatgggctatgggcaaagttctgctaggaatagttgttgccctgaagtgctctcctatcctttgagtcttagagaccctaggtaagacaaagataaccacataggctgaggtactgttagaagtaccagcaaaaagaagctggcaagaagctacatgaagtatatattcgccaacatgcaaatagctgaggaatagttttcctctactcaaagacaggaaggagggagggagggagggagggagggagggagggggagagagagagagagagagagagagagagagagagagagagagagagagagtgagtctcactggagaaacatgccattcttatgtgtggggcccatatccaacagttagttgaccaacacaatggcatctgcagaggttcttggtctcataatgttaattcatggtgtttctcccccccatatcttaaaggtcctctgattatgtattagagcttctagttttgtgagttttgcattttttatgagattctctagtacacaaatatgtgtgtctctacatctatagaatcatctagaaatttttctctttggttctttttcttgcttggctgttgcgttatcctaatttgtttgttgtttgtttatctttattattccttgatgcttgtttgcttccttataagagtcagaaaaggcagggagcagatgggaggggaggtgtaggcaatctggaaggggtaggaggacagggaaaacaataaatatattatatggaaaaacaatccatttttaagaaagccctcaaaaaataaaacggaaactatcatgccaagaacaaagaaattaaaacaactcatgccaacagaaattaaaaaattgtttgaattttactgacaaggcttttaaagcaatgaaagtaattataagcttattctcagaaatgaacaatgaaataatgcataagaaacatattatttaaacttattcactaaagcatacattatttcaacacaaaaattacaaatcaatgctggatgaaactatggtataactaaatggaaagtgctatgccatgcttgagatttagaaaatccaaagtgatgaaaatgacaattctcaaattgatttatccaatcaattcaacccaaatcaaaacatcaaaaataaatgttattcatgtaaaattcagcaaacagattttaatatttacatggaagtaaaattagtgaaaacattaagaacaatgaaaaagtaaagggattctcaccatctgatataaagacttgctctttgttctatcaaggtaaaggagtcatcaagatgtgattttgatcaaagaacaaatgaataagcagagaagaaccaagtctagaagtaactcacacaaaactcaatttcaacaaaaataaaattcagtgggggaaagaaagctgcagactagaataacacatgtataacatgtttgcatatgatcctttaaaaagaatacattccaaaagaaatagttcataatcagtggaaagaagagtggggaagataattcacaaagtaatggttaaaaggatggaccatctagtgattgccatatctggggatccaccccataatcagcttccaaacgctgacaccactgcatacactagcaagattttgctgaaaggacccagatgtagctgtctcttgtgagactatgctggggcttagcaaacacagaagtggatgctcacagtcagctattggatggatcacagggctcccaatggaggagctagagaaagtacccaaggagctaaagggatctgcaaccctataggtggaacaacattatgaactaaccagtaccccggagttcttgtctctagctgcatatgtatcaaaagatggcctagtcggccatcactgcaaagagaggcccattggacacgcaaactgtatatgccccagtacaggggaacgccagggccaaaaaaatgagaatgggtgggtagggaagttgagggggggagggtatgggggacttttgggatagcattggaaatgtaattgaagaaaatatgtaataaaaatattttaaaaaaagataaatacctaaaagacagctcatgatcctgagtcatcagtgataagcaaatttatactaaggtaaaattttatttcacactccaagacaacatgaccaaagattaaaagagatacagaatacgttctagcactgcttgtcatcttaggtaaaatggcagtatcattttacaaaagcattcttgcagtgcttcttaaggttaaaaatgttatttacttcacaaccacaatcctccaaagtgcttcttcaggagaaatgaaaacacttcaacactaagaatgaaaactttatttgtaacagccccactgtcatgataattctattgccaataacaaaaggataataatcaaaatgcatacattaatcataatcaatctaaaacattattttgccatattgtagagataatactaggatattcccattaaggcttctgtattaccatgtttatccctgttatgaattacctttaaaactgagcagcaatataatggttgccacttttgtgactggtgttagaagcaaatatgaatgataaatttttatattcattaataattgccattgtgcttagaaatgatatatcatatgacatgttatggtttttgttttgctttactctgaattttgttatttaattacctaaaagctgaataaataacatatttgcttttctattaaaaaaaaaagggcaaagcaagagtaatcttctacaaacttaaatgaataaagtaatactgtaatataaatataacaatgataatgtatcattactagacacagttaatattcattctattgttaacatatttgagtcttatagctcaagtgatctacaaaaagataactgtttaaatacctatgacatcatagtggatgccaaaaagactactctgcattttgatcagtcacattagaagatggggggaaagatctttcagaattggatagtagcatattacagaagtagaaataagggcatttgactagagaacgatgttagtggtaatactgtcctaagaattgttcagaatcactagtatacatggttcttcccaagtatcttaaagactaaataatgtgccatcttacacatgaccaaaaataaggcaaagggttgagaaaatatgagacttaaatcatttaattcatgaaataaagcattagactgcatgaaaattggaaatattaatacaggtctatttttgagcttacttgtttggtaaccagtacctacagatacaggacacaaaagcacacatctacatgtttgatgaataaaatcttcctttttaagaattaaacaccttacctaatcacaacagattccctcgtatagccaccgtcatactctgtagtttcttctagtgcctggaaatctagattctgaaaattatagggggaaaaaaaagcaccttaacatccatagtacaccaaaacaaaaaacaaaacaaaacacccaaaacaaaaaaaaaaacaaacaaaaacaaacaaacaaaaaaaagaccttttttgtatatgtctttcttacccggcttccacatataagcaattcaatttcttctggtctgaataagtattttaagggcgattcattagtcaccatatgaaaacctctgcgaaatgccttgaattgtttttctacagatttattgagaatgtagtctgaatagagattgacaaattcctgtaggaatattaacaagaaagcatattctatacaaatgaaacacaattagcttttggactagttttaatacccaccctccaccccaagaaaaccttcagcagtattttttttgttactatgtttaaaaattagatttcagagagttggttcagtgcttaaaaaagcattagcaactcttgaagaataaacataagtcttaaaaaattaatcacatgttatatgtacaaagaaaattattttcacaatttctcacttctgacagatataaaagttgtattcatatgcatagttatacattatgattctatgagtaaatcaaagagaaattatataaaatgtaattaatagtaataataatgaaataatgtaaacagtaagattaaaataaaagatttaaaaagactgtatatatatataacaacagaacctctagtatgcaatataaatttgttatgaatactgaacttgagaaaaccagaatgtctcaggtttcctctggaaattatggtactggtaagttagctactgtatccagctcagcaaaaatgttatttgttggtaaactaagctattataacaaattataaaattttatagtttttataactacttcaaaccatactaggtaattctttgaaaactttacaaattataaaatttgttatagtacaaatgtagtttgtatcatgacagtacaatatttcaccaaaaataatagtataaattaatatatcttaaaattatactatgtaatattttcttttgaagctaagttatttcctattgccaagtaaatagcttttaaagttagtaaaaaccaaatctaatgtgaataatctgatatgcataattagatctcatgacagtacaatatttcaccaaaaataagtataaattaatatatttcttaaaattatactatgtaatattttctttttaagctaagttatttcctattgccaagtaaatagcttttaaagttagtaaaaaccaaatctaatgtgaataatctgatatgcataattagatctcaaatggaaaatgtatatacacactaaaccagatgtcaatcactgggctctgtatacctcttaggtttaatatggtaaggccctgtttctagcgttacattatagtaatatttacccattcaatcttttgtagtctgtttagtctttctctaaaggggaattaacaattctgtacaatcacataagctcttatctaagaggaaagtgtagctttactatttagataaatttgtttatgtaaagtttttataactgcttcaaaccatactaggtaattctttgaaaactttactgctttgaaattatatatttataaaacaatgacaaaaatttaattaccttcctgttttcatttgtaattggaattttatcaccattttcttttagatcatacatcattgggttaccaaaaagatctgtctgtgatatctggaaagtgatcatcatatcatcttccacactcccttcatattccaataaatcctttaaactctgatataaaacctaacaaccagaaagagaagtgaggttgccaaataaatactaaaagaaataaaaataatagattgttcattctttgtagaaacaacttgtcaacaaaaatgaagccataaatattccacatctctcaagtagtttaataagatagaaaggttgtcacaggcaatgggtcaatcttaaaaattcttcaaatgatcagttcagcaacagatttcataccatggtctagaatatacactttctctccatgattgtggcagggtacaggaaatgaggaaaaacaaacaaacaaacaaacaaacaaacaggaaaacaaacaacaaaaaagccacacacatatcaactgtacctatcaacaactttactacatagactcatatgggacattgaaaacatgatgttttcaacattttttatggggtcaatcaaaacatacttgataggatatataaaaaatgatgtttattatacttaaccagattaaaagtattttactttactaaacagcagtatcaacaaaagtttacaaataaataatgttcctatataaactgagataaacttctgtatttagatacaatcttaaagactattaacgaaggacaacttactgggtgagagtctcccaagtcacgaaaggttccttttttccccattagcttcctgtatacaaccatgggaaaatggacatccagtatacaattattgtaaatagccagacccaggactatgccaatcagagtaaactgaccctcagtttcaaaagaagatggattaaaccaaaataatttcgtagcttcatcatatgtgaacatacctataaagaaataattaaaagtcattttatccacttaatgactgaaaattacatatgaaacaaatgcatgattaagtaaaaaaaaaaaaaacaattggagaaagttgattaactttaagttacttaaaattcatatcaaatctaagctaatataattttaaaaaatattttgtgatctttcagcttcacatgatcttcattattcaaagccaaagtccagagattttttttcctatcatcattattttatctaggtgaacattaagagatagtcttttttttctttttttacggaacatcaaacaataaaataaaacaaaactaattgtatatgcctttcaatttttctaagtttattttcagttgcttctcaggaaatactttttatacaaagtctaacaagctgggggagagagtgggctgtataccttagcacttggtaaaatgagtaaggaaaattatgagcttaaggttagagtactaatacaatataaaaagattgtctaaaaaagccaaaatcaaaatgagcaaatcaaaaagttttgggaaatgtttttctaatggaacaagagtattaaaaaacaaataataaagcattaaaatgtactttcaggttaattttaatatttaaaatgtttccttattttcactttcagttttaattaaaaagaaaagtacacttttctccttgaactgtagtaatataaattaagtctaagctttttcttgcaatttaatatttgtggaatactggtttcacaagtattcaattcatacttgcattccagcttgaaaaatgtgagttatgtatgtctgtatcatttgcatgccaggttatacatccaggtaatatcaaaagttccagttcacaaataataaatctgatagaatgtcaccaatggatgctcttggtctcaaggacaattaagctataaattaaccagaggataaattatataacctatgattctcatgacttcaggttttcaaatctaccactctaaggtttttcaaattaaatttccctagaaggcaactgtgttctactagaatatttgactaagtaatatatggaagaacctaaattaagtgagtgatagaacagctcctgaagcagggatatggcatactcaatttttttactgcttaccataactgaaaatatttataaaccaagtttatactttaaaagactaacacaccatcataatcatatcactaatacttaccaatatctggattaaaaatttcctccacaaccaactgaaaaaactctttggaaacgcctccctcatctactccttgttctccttcaaattccacatacaactgcttcttcaagtctgcaggattttccatagcaatcatctctagctgttgattgaaaatataaaaaagaggacagttgagaagaggaaaaatgtaagatataagtagaagaaaataagaagcagcaataacaaaacaatatggaaagaaaacaatgaattttgtttctgaaaagaaaaaaagcaaactgacttacagtttttggcaagatttatttcaacacacaagagtatgtactgtgtttaagaagctatgcatttcttagtaaaggatatagccaaaatgctgttgggggtggggtggggggaatagttgcaattatgtcctgtatatcttcatctttaggggtctaagggcctatgaatttattctgtaaagaatctctatattggtctactttaactaatttgtatgtcttcatgtatgtatattcacatgtctccttccacctaagatgtatttcctcaggatctgtccaccttgtttgtcaggaaaggatctctccttgacctggaagactgcataacacaataggttggactgtcaatggcccctggcatctctgccagtacctgcctacctagcatcaggactacaatgcccacttcaagtttcttttctttaatagagttctgaagattaaactcagttcttcttgcaagttgatctaccttctcagctcgcatacccaattttcaggtcagtattcattgaaatttattttcagcagtactttgttggtgaacatataagaaactgttctttcacaagttccacatatcaccactaaatattaacatttaattactaagcttcaataaatcaatcctattttctaatgtattacagaaacagaggtaatattcttcctactctaatggtatatgcttaatatatcatttctaaggagcaaaactgttaacatattacccttcaaaactatagacttttaaaattcataaatttatgtccccaagaaattaataggtaggtctgacactttacagccaaatatatagatttgaatttaaccttagaaatggagaacaaaattataccaacaacagcattagctagaaacctgttctaagacagaataactttgtacacttaaatttccatgatcatcttagctcaaatttggtcccaacacaatatactattattactgtggtttctcccagttctcaacttgctaagaaaacatgttaattattgattcaaaggcttgttggtttcaagacagcatacatctgtccagtctctacccttttcccccaattctggttctagtatgttctattatgatcactaaaaataattttctatatttttgctttcgtttgaaatgtaaaataagcataatgagatagtatcaaataaataagtgaagtgtgtaaattaatgctctaccattaactctaagtttgaagttgcaagtattgtcattctagtaatttttaaatattccatgttttctatatatgatagaacaagcatttcatcccagcactcaaactcggtaagtttagtgcagttatgtctacacagaaaatctgagtccagtgagagctttatagtgattctctatctaaaatatgataacaagtaaataagtatttccagttttgctagaatatttaaccacatgattttaaaaacagaagtattcccggaataagagcagcagcagcaacaaattatgaaacttacagctcactttacaattaaaattgttctgatatctacaactccttagcaagtaggctgctaaaaccattttacagaaagtcccttgaagtaataaaaggataaataacttaagaaatagtaattcagaagagaagttttaatccagggagcaagcttatagcccacagtttacctacttttccaaagaaaatagagataatatttgcttttagattttgtgtgacttctttggatatcaatattttcaactatattcacatattattttcagaatcaggatatatttgtatataatttaaaaatagttggcagcttaattctgtaagtgaaaatgtccaactagcaatttaagaagaccattctcaatgttgccaaagtgactttgtaaattcttattttgtttgagatgatgcatcagtagcctgtctttttaaaaactatggtaacaaaacaaaacataaaatttaatactaaccatacacaaaagccattagcaaagaaagtcacattatttttttttccttaaatatagtaactcttgctgagaggtggtagcacaagcctttaaactcagcactcaagaggcagaggcaggtggatctctgagatctagaccagactagtcaacagagcgagcaagttccaggacagccagggctacataaaccctctcaaaatacaacccgcccaaaaatgtaactcttagaagagacacacacacacccttaaaccattgtttcatcaactaaagaatagtataaaaaaaaaaattaaagttatattttaaaaatgaatttgtaaaatcaagctgtcttacatgtaattggatacatgaaaactattgggatatacttaaaattctgaaaaaaatataagacaaaataggtagtattggcttcatagatagcgctggagaaaaaatacactggtattactatgctgtattaatgtacaatagtaactatcacttcctaactgtacttctcttcatactaggaaatctcactctcatcaactgttaaaatattattcttaatttatttggcaatacaaaatcctagagagatcattttttacaagctgaccttataggagagcattccaagaaatctaagcagaatgatatactgatttaaaaaaaaaaaaaaacattctataaccatatcttcaaggatcaaaaaaaaatttagcgccatcatttaaaacctttagacagggctggagggatgatgtatcagcagttaagagcactgactgctctttcaagtcctaagttcaattccaagcaaacacttggtggctcaaagctatctgtaataggatctgatgctcccttctgatgtgtctgaaaataaataaacatgaaaggaaggaaacaaggaaagaaggcgggcaggcaggcaggcaggcaggcaggcaggcaggctaaataaaacctttagacatccagagttaccatctaaaatcctatgttaacataactgaaaacaaaaaactactaatgatactatttaagttgaacaacactcaaattagctctatttaaaaatgtttagactctccaagaagagtaatttatacactttgataaaaatctaaatatgactttcatttctataagtaaaaatctctctaaatttctttcttttaaattattatatgatgctaagctcttatcgtactgactacttcatctcccattctggttgtaagaaattattttgaagataaagggaagaggattccattaatttcttttttttttctttctttctttcttcttcttcttttttttttttttttttttttttttttttttttttacacgagacagggtttctctgtgtagcccaggctatcctgaaactcactctgtagctggcctcgaactcagaaatctgcctgcctctgcctcccgagtgctgggattaaaggcttgcgccaccacgcccggcttccattaatttctattagaataattttaaataagagaaatcacattaagtacaattctattaatgaatgaattacacctagagcagcacagaaaaactccattattaaagcaatgtatgtcaaatgatttttttaaatcaagttcttgttgcaataggtatttatactaagagaaatgatggaagctcagctagacaatgcatctagactttcagagaaattgaggaagtaattcaaacaactttttcttcatcgatgtgtgccagctcctgggtttttggacttttctttccaattctacaacttagcaattatttttggttaactatggaaaattctagaacttaactaaatttattcatgtcccataccactgtcaactcctattttagtcacactgacttcattattcgttttaaacactggcaatattctacacatggatattattcaataatttatacttataaactgtactaactgttgtttcccaaatattgatttgtagcatagatgtaccaaaacatgtaaagaacagaccactacattttcatatcagaattctttttttttttttttcctatcagaattcttagtctgaactcctaaaagtccagaccttaaattctgttgctgtgtttttattttctgggcaattctgcttttagattgtgaacgcagtctaaagcatctcgcacatggcaatactgtctctggatacatctgatcttattccactttttaaaaaaaggttttaagattttatatatgctatatccttgaaatcactttattttttaaaaagaggagaaaaatgtgccatttatttgctggtggtagaagaaaacatgtgccaaggagttaattacgtcttgtggattaaactcagtcatcaagcctggtggcaagtgactttacccaataaaccaacacaacagcctacaaagaatatctgttttttgtttttttttttttgttttatttgtttttttttttttttaagactgttaaaacttctacactaggattgttgttcaaatggaagctgggatctcattagtatttatatctgtataattttctcgttaaaaaaaaaaggccaaaaccattcaaaataaagcaaaagaaatattggagttttttcctttttagtagaatttgtagatttatttctttattatttatttattgcttagtacatacaaattttaaaaaatagtaccttatacttttatactgactattctcttgtgagacagatcttctaaaaataacagttgggggaaagagttgttatactgattgaaaataatgaataaacttttgcttacaaaaaagaattggctaggagtgttatacacacataattttagcactcaagtggaaaagataaacaagatcagaagtccaaggataggctaaacattctttattaaataaaaataaaaagtgatttccaggacagccagggctacacagagaaaccctgtctcgaaaaacaaaaaacaaaaacaaacaaacaaacaaaattaattctaatttactcgcctactgtctaccattaagccagctaatctaattaacactgaaatgtgagattcaatagaaaacttacaaaagtcacatatgtaatcttttctaggcctcacttataaactaaggagaaaacggtattatttccttcatagctcaaggttagggttctataacctttctttctttctctctctctctctctctctctctctctctctctctttctttctttctttctttctttctttctttatatttattaatgttgagttcactgcaaaacttctcattccttctctatacaaccttactatgcagttcaaaatgaccgggtcataaaagattgtgattaacatgaatattctgccaagtttttttatgaaagaaagaacaaggtttcaaaacaatagggatttgtggagaataaagacgtggaaagagagtagaattccatcagttcatatgtgggtattcttttgaatacagcttgctgtaaacctccacctttttgctattaatctaatatgaatataataattatcctttgctcagggtcatcaatttgatctctaaagtctgagtctttgcttctatttctaaccctttcccactagtatgctgaaaaaccaagaaattttagaggggttcagttgaaaatgatccagaaagagaaaaaaagaggagaagtggaaaagaaagcaatataggacaaagaagagctgggtgaaactcttaggaattttctcaaaaagtacctatctttgtaattctactgcttatcaatgagacaaacacacagaattgatgaaggccagggcttctataaaatactactagtcgaatatggatattatcaaatgaatcatgtcaaaccatatgactagttcacataaataagatttactagcaacagtttgttagcataattacaagactcaactgttaattttactccaactacagaaggggctaatttcgtcctaaatgaaattttacaaatactatccaagttttaactggttcttaactcaataactttattatagaaaaaaatagtataagaagataataaaaaaaaaatcaggtaggacaggtgcataaattttttattaaatgtgtatttagctcagtcttaaggcttttcagatttcgacaatccattcccccccaaaaaaaataaatgttcaaataaatattatttgttagttatctgttaatgagttaatattatttgttagactataaggatgatgcttcaatctgtaactagtactaaatcttacatcaagtttatacaagaactagcactaacaggaacaattaataccaagggataccctgaattacttatatataattttgttaatatgtgactgacaattttcaaaccaaatttctggtttaactgacagggactctgtaatttttgtcgtctgtagaaaaaaggaagacaagaggcaatgttatttgaaaacaaaaacaaaaatcacgcagtaagaagttcctgacttcccagttaaatcatctagatttacctggtattactaacattaattccaagctcccaaaatagccactttacagaattttcaagattcatgttattattatttaaaaaaacaaaatcctacaatgtcacacaagacagagtggcttagaactccaaagtcttattgataatacagactaacctttcctggtcatatcatcaagttcacaatagaaagctgagttgtgttacacataatggaatttgaagagcagctcttattcttttacaatgtacatttattgcattatttcttccaattccatcttccattcttaaaaatgtgtataacaataccatttgtcatgtgttccaatctttgaaaaccaatcttttcttcttaatggaaatatatgaggctggctttcaagattcagaaaatccattccttttacttgctttgtgcctgtctgtctgcgcatctgtgtgcatatgtatgcatgcatgcatgcatgcatgtgtgcatgtaaatgccaaaaggggaaaacgtatgtgtggaggtcaaagaacatcaagtatcagactttgctttctaccaactgagacagggtctagttatttgtcagtttatatatcagattagcttctgaggatttttctgtctatactttctatcttgctttaggcagtactattacaaatggaactaccatatcctgttttacatgtattcagaaaatccaaggataagtcctcatgtttgcacaacaaacgttttaaccactgagtcattcccctagtactagaaaaatctattcttcttcaaaagagaattatcattagacaaccaggataccagtatttttggtaagaagcaacaaaggtgtagcaatacagatcagaaatgttaacataatcctatttttttccaaaattatagataaaatgaataaattgaaatacatcactgtctaggttttagtttaattccaattttaaataatagtcaaacttacccggaccagtgcatcatctataatatggtcacgtctgactttgagtctcaaatacggattcaactgctgtccttgaactaggctgtaaagaacagtgattcttctttcactgtacatgcgaattctattgtcataatataatcccagattctttgtgacagcattcaatataaagggacatgtcataaaagagaatttgttctctgtttcaactttgaaaaaggtataatctttgtccatttctagaacatcattcagtggttcattaatgaattcttcaaaggagataagtggttttcgacagtctagagttttaacgccaagttcggtttctagtggatccactcgaggacctttcttatttcttctttcatctcccagaagctcctgaagtgttaattcgctggactcaggtatgggttcttcatcatcttcctcattatgatttgtgtccacatcccctcccactacatttgcatagtaaaccattttcaaacactttgaagcagcaacaatggcatcatcatcattcactagatttcggctattaaattcattgcttatgactttgtaggtaataagttgctgaaatgtttccatcattctccgaatctggtcagcactgtatttagaccacagcctaatcagttttccttgagcttcaaggggtagcttacacatagctttgcaaaataatggcaacgccatttccagatattcaggactgtggagattactattctccattacaataatgaacaaattgagataattaggatctcgagtatacacattatgatatgtcaaatcacattccacgttaggtgacagatatacaagtgcattcaggaaggcagtttctaatttttcattagcgagcaaactgctgtagacccttctaatagcatcaatatccacagtcacatcatcaggacctaatttttgtacattgttgtctccctgtgaactatcacccatccttgaagaagatgcttctgagtcttcttccatagcagcagcagaacatgcagctttttccttttcatcttcatccttgtcttcatccttttcttgaagagatttcaattcctcctttgtgtgctgtttgactttccgaaagctcagaaccagtgcctcagcactagaaaatattcttccaattacacgaattaaaggggaataatcctcactctctctacaaaattcataaatttcatatactttctcttcagttaggtaaatcacatctagaaaatggaaagaaaaagaacatttatgttgtaatatacatgtttattttgttaaaataattgctagtgaaaaagtaaaatatctaaacattctggacttgatttagaatttttaaatgatgtaatttacttattaacaagtaatcccaacaatctcaccctttcttggcattcattgaacaaaatataattattaattatgcattgataattaagacatgccttgtaaccaagacatgtactggtatgtaacattaattgtaggtatgaacaaatatatatacttgtcatttcctcattgtactttattacaaccttaacaaaaagctactatataaaatcctgaaatcattttcctttgcattgttctcaaaaaactaaggaggtaaggttttataacaaggtttccttagccccttcatttgcaatcaactctttctatacttttgtatatactaaaaccaaactgactcatcttatgtattcctaatttcttccagaatttccattcagaggctgaggaaaagatattactactcatgtaaactctactgaagttaaaactgctactacaactactactacctatgaccattactcaggttctaacaattcttaacagagcaactggaaattattacagtcatcagtcatttaaaaacaaacagaagaaagaagctaagaaagcaaaaaccacaagcactaaaacctatatttattttctcccagaaatagaattgggatcataaaagtctctagcttctcaccactaggccaaatgtaaatttcaacaaaggctttaccatttcaggttaacaaaacaaaagatacttatctttttggaaaaaggtaacattttacatattaaagttttagaaagtaatatatttatcaaataataatgttgaaaccactaatctctttcaccaaagagtaacatattataattattaaacatttaagttaggataattttatggttacattgataatacacctcatacattgccaatatatctaacatgtaaaatctttattatgattgctacatattattaaaggtacctaattcaaaaataagaaacaatataaaattcaagtcctcattgatggaatggcttccaaaacataaaccacaaagcactaaactatatatactacaaacctgtctatggcccattctagagtattgatactttttaattttatgatcttcaattctttcttttaaaaaaatgttctatttacttattagaggtgatgagggtattgagctgagttgataacctaaaagaattaattttctccttctacagtgtgagtttcagtagttacatgtccctatctgaggcagcatggcaagccaagttcaattcttagtctactaagaataagtaaaaaagaaaacactaacatggagctcatttctcgttattctaactgaaaaaaatacatggaatcttctttaaccattcaagtctaccaaatttctctaaactgtaaccaaaacacagaaaatatcagtaatgaataaataggcagactgttagaatataatgttttatctccctatcattgaattataaaattagttagaaagtgcaaattctacatacagaacaatatacatcctgcctgaaagagaataaagctctagatccacacacctttgatttgcaatgtcttcctttcagagcacagtcattaaatcactctgacattctagtaatacaaactactattcattgatatttgttccacgtagtactctacttaaaatgtttaaaatgtttatctccatctcccccacccctctcatgtgtgcatataaatcactgcaatcagaaataaaaagttctaatctgggtatcaacaaacagttaagtaaagaaactttttttttttaagattcacctgtacattctaatatatgtgtgcttgaaaactgtttgagacatggtttcacatagtagaaacagaactggaaatcagctcaaaatctttaaaacataacattttatactccaaacagtttcacgcaaaaacagagttgtgatacactagctgataactacacctctaactaaagtgaacaaatataattatcaaactgagggaaacatgattaagcatatataattcaaaaatattaaagaagtaaaggcaataaaatttggagtgatccacaaaaacaaagaacctgtaaaaaaggaacacccatgggctaaaacaaggcaactatatccattatatactagatttttcccacagttagttgcattcaactatgatgggatactatttttcatttactgttactctgtcatgtccactctgttgtagaaacatgtataattgagccaatgcaattttcacattcaaaatattgattagcattcacctacttatctacaatgtaaacaaattcatgaaataggactggctatatatttttgagtagcaaagctgaaagtttttttttctgatttttctttagtcctattgtgaaagtaatatcatgaagttgtactataattttatttcactaattcatttaaacatgtttcaagtgatagtggaactaatccctggcaatctgaaacattcaattacttccattaagagaaaaaaatagattgaacaaaatcaatcatgaggcaaagtaggaaatttgaagaattttcaaaatatagaactatttttaaaatactagatgcattggggacatagcttaatcgtgagtgcttatttttcactcatgaggctatcctcagtaccaggtatcagagtataaaactttaatttcattactggggaaatagaagtgtgagtattaaaagtacaagaatagtgccacttaacttgcacaaaacaaaatgaaacgaaaccccacaagagctgagtaaagactattactggtaagttacgtccctaagcagtatgaaaatatctaattcctgacgtagagagggcagaatgtaagaaggaaaaaatgtaattttcagataactattgcaaaattttaccctgctttcttaaaaaaagaaaagaaaaaaaaaaaaagactactttacactttatatttgtatttctccttttaccacagtccctggagttctagagccgatactaggtattcacggcaaatgcaatgtacatagtagatttttgtgacctaataaggtattagctacaatataaatcattacaaactgagttcaactcatcatcatattaatttttagagtataacttgcttctgactgacaactaatgaatcagtaaaatataagaataaaatgtaaacaaactaaataccagtcctttaccacagtttaccagaaaaggtgacttttactatattatagtgcgataacttaaggtgataaaaaaagcaaaaacaaaaataaaaacaaaataacaacaacaaacaaaaaaacaaaatcaaaacaaataaacaaccccctccacatttaaatctgatatagctttcaattaaccattttgaattgaaatataatctcttacctttaaaatcttttccttccttcttgttcatttttatctctgagttgttagatgcaccttttgagttctcaaggtaagctgagcttgctcctttcttggagggatgaggatcacagagttttgcattaattttataaagctcaagggctttaatagctgctgcattgttatccatacgaagaaaagttggacaggaagcacaaaactcattcgtgcaggcctcatttccacagccctcagttaactgatggtagtagcgttctattagatgctttgcagctgctcgcttcctgtaccagacattcaaacaataagcacatttattagtatagctcagaaacaaagcccaacagataaggcaaaagttagctaagcaataaagcaataaactaaatatttagatgtagaaactggaaattcactactacctcccaaagtgttagtaaaataataaacattttctaaaaaaactgtgataaactatgtcagcttataagataattttaatatggcaggcttttctttggtttaaaaaaagataagcttaagttgatggtataggacccttaactatttagcagaaaacaacaaaaacaaacttcactgctacatctccatggcagtttcccttttcactaatataaaatcactaattcattttaacagtttcaaatacttgatttccagttaatatcaaacttctagagattaaaattttttactcagtaagtaatcatgagatatttaaaagtgctttataaataaactatctaatttcatattataccgagagagaagcaccaaggcatacaaccttgagcccatacttgtcactatcttcattaaatccttgtcataggaaagataaaggtttaaacttccatcaggggaaactcatattcatcttacttcatcaactttaaacattaaaattaacatttgattaacatatttttcatgcaaagtaaccaatacaattaaaggaatgaattattttaccaaacaagaagttgttctacataacctaaattctataatttgactctaaaattctattcttggagattaccacaaaatttaagttgaaatgtatatctggcccataataatgtcattctaaggaatccgtttggttctatacaagcatgggaactgcaagtagaaagaatctatctaatttcattctaaaacttcatgtcattattttagatagaactaagtgactaatggcactagagataaacaaatatggcactgataagtgactttaggactatgtcattctttgtatgacaaagaatggtatgtcatacgatcctaactcattcagatacttatatttagaaatattccctgtatatttaccatgcatagtgtacaaaggccaagcctgatgactcaagtttgatccctgtatccaacttggtgaaaggagagaactaattaccacaagttgtcctctgaactctaaacacaccaaaacatatgcccagtcacatgtatctacagaaaataaataaatgtgatgaagtttaaaatgtatcacgaagttagagataccacttatgagaaaaattcatcaaaaggaagacttatttccctattatttatggaaactcagcatgcttaacaacagcaaaccgcttcaatatactgacagcatgcaccaaataaaataattaccaactactttaattttgttacttccttaacaaaagctagtgatcaagttataaatgtaggatgaatgtttcgaaatattaactatttttctaaataattgactgagttaattcttcctagctacgttttttctgtaagtatgtacctaaacactaaaaatttctaagtatcagtacggaagttttaaaacttcatctacgtgatttaaatagagccaatgtttatgtttatatccaggatttttaagcgttaatttcaaagttcaaaacactagttttctaagagtactaggccgcccccccaacccatacacacacacacacacatacacacactacttctttatgtgataaagaactctcaatactgaagggagaaatgagaccatccaaaagtcagctcaatgtaattagttgaatgaactaattttctaggcctcattttaccaccttatgtccttataatttgtctagctagcactctctacatgccaaataataaactcagtacattgtcaggtactctgattatcatatgaaacttgaacttgaagattatcttctgtctacagctagtaaaagagaaagacctgaaaagatcaaatcttataattgatcttatgctatgtccattaaagaagtcaggacaattttcagcttcagaattcaatttatttccaatcactgttttacagattataatttcagaagaattaattcttaataccagcagtcctaaaaagttttaagggggaaaaaaagacctaagtaatatataattagaaaacaaaatcttccaaaaaattccaatctaaacttaacaaccatgtgtactatctgggtacagtatagaaactcctgaataaattatatcactatacttaagatatcggtaatttattgaaaatggatatgctaagcactttataagaagactcagtctgtaacaggtagaaattcacaattttgaggccagattgtttgggttcatgaacagtttctgtatctgagttaactacttatttagtctctttctgtgtctcagcttcctcatccttaggatgccagtatatttcagaattcaaatgatttaagaattacaagtgtttagactatttcagtaaattttggaagaggtaggaaaaaaataggaggtgaagatgagcaaaatgcattgtatcatatatgaaatcctcaattaatggaatagtatgtattacctgctacatgctaggccctaatggtaagtatcagatgctattgcaattgctataatttctatcatttgcatgagtatatgacttggtcaagagaactccattgcactaaatctgaaaaattaaaatctaggcttaattccaaaatttgaaattttagcattactaaaggggagacagcagagaaaatgtttgaaactgaccagcttttttgcaccaagttacaagtagtagcccactaatactaataattatattaaattaaataaacagaggtcataatcaaccatattaagttgactaatttgattaatgtgcgtttattaatattaagttaattaaattggttaatatgattgaatatgattaattaacaataataagctattcttttctcattataaatgataccattgaatgccaaatgcagggcatataaattcattaaggacatgtaaaaggcctctaaagttggaaacatacatactaataatagcttttgataaccttccaatgctaatccatacataggactggtcactaaatcatacctcatgtgtcaaatctactttttttacagttgaagtttagaatattttatagtcttaaatcattaaaaaattatattttgtttcatgtgtgaaaattgcataaaacttaaatgtctatgtccataatttctaatgtaacatggtaaatttcaagtacttgtatatttcctgtatgttctctatcataatgtatctagccaaaagtaaaatgctttgtcaccttaaaatgaattccctgtgcatgccagtgaaactttcaaccaatcatctggcctccttactttctctctttgtcctcagaagatgaatagagtaaggttctttcttcctacttagtactttaacaaaaagggagtggggaagtaggaaggaacataaaagaaaaaccaaagtaaagttcaggaaatgaagtgaatccgtttcctgatattcataaccaaaactctacaaaaaggaggtagcagttacttttgcctattcatattccactgacttcgtggaaatcaaagtacaatatagtgagtccttaaataaaaatatgccttttttatttagtttataagaatcaagtgaatcctaccagtaaaagtgttcctctttaaataatagtttccacttctttattactttctaagaagccattaaaacggattctacggaaactgatagaagcagatgcagggacccacagccaaacccttgaagagtcctgctgaagaggggaagggagccaaaggacaccacaaaaacatagcccacagaatcaactcagcagggctcataaggggttaacagagactgaagcaacaattggggagtctgacctgggtcttctgcatatgttatagttttgtatagcttgatgtccttgtgtgacaattagcagtgaaagtaagggatgtctccgactctcctgcctgcttttgagaactttatcctcccaatggcttgccttgtccaccctcaatgggaaggttatgtgtgtgcctaatcttattgaaacttgttgttatgccaggtttggttgatattcatgggaagcctgctctttaatgacgggaaagaagagggtagtggatctgaagcatgagggaagggaggaggaaagaactgagaggagtgcagggagaagaaaatgcagacaggataaactatatgaaagaattaattaataactaattgatgttttccacaaatgacaataaagagaaataattttcagtgttctcagtagcactaataacattatttgctgggtcctaagttaatttcgggatagttgaatacttaggaatagtaagtaaatcataataaaaatgataaagttataagatattcataactatatatagatagcatcaaggagattatacactagaagaataaagaattcccacatagttcagcatgagaatcaaaaacagtgaaatagctgccatgaaaacaagaaacagaaacatgaaagagataactaacaatatgacttattcaaagtatcttttttaaaaaaataagcagaataaaaacaaagattggacaaaagaggtaagaaacatatacagcccaagactcaattaacccatgcataatctagtaagcactgcttagtgtctttcataggtaaatgtctcattattttgtaaggggttttataaaggatgtacctttataaaaatcactactcctccaagaaatggtggcttatgcttataatagtagcatatactagactaaggcaggaagatcttgagtttattatgaactttatgtggaggaatcagtaaaccaaatttcacaacttgccccaagttatttttaatgtagaaacttgtcaagagtaaaaaatgtgatctcacaaacaccagagatattcataatacagttaaaaccagtataaggtagggtctattgaagtgtcatcaaatcatgtattacaagactgaaagtacaaatatgacccaattagtatcaggaaccatttgaaagtcaattatatataaaataaggaaaatttcttaaagacagatagatgggtggatggatggatactaaaaatgcttttattcatctttacaacaaagtactagttgtaaaaatagaactgtggaattaaattttcacatagaattatttatcttttaaaatgaataaaccactgtttttggggttttttttttgtttgtttgtttgtttttcacctgcccagtttcatggttagaagaaagtaagtaaacatttacaaatttagaaattgactagtggagctggaaacatagtgtagtagaggcacaccaccaatatatattgtataaatatataaaactttcaaagaatattattttttaaacaaagatcttttcctaaaaccataggttgactcttctttctgtaaacagaaggtgaatattggctgattgtagtgaatgctagttttagaacttgtatatttcctaagtaagaattttgaaaatggaaatctgtcctgtattagtttggaaagagttagtaccactgccatacaaacagcagatacctgataggagactagagtgatggctcactagtcaaaagcactagctgctttttcagaggaacagagttcagttcctagcatgatgtcaggtggctcacaaaactgcctgttcctccagcttaagagcattaaatgccacaggcacccacacacatatagcatgcatatgcatatatgcatatatatatatatataaatatatatatatatatatatatatacacacacatatacatatacacatattaaatctaaatacagtcaaaaccaatgcacaaaacacatttgaaaaagaacacatgtccttgctaaaatcccattacttaaaagaaatcttgtgaagccaaaaggctttcagacagactcatttgagaacatgaataaccactcccagtgatagagatatctcagtagttaagagcactgattcctcctcttccaaggaatccagatttgattctccacaccaacaaactggtgcagtcagctgtgacacctggaggagttacacactcatctggtctccatgggcaccgaccatgctacatgtggtgcacagagatatatcccagcaaaccacagataaacataaaaaggaggaggaagaggaagaagaaatggaggaggagaaatatttactcttaccacctctaatggatgaagtacaatatctaggcatagctatcagataagaaaaagataaaagatacaggaacatttggaataagatgcaagactacaaggtgctaatgtgataaagtgaatgaaaacttccagagtatcaaaggataaattcaaattctaagagagatgaagaatattggaaatcacaaaagagatactacaactgagaaacagagaaaaatactatgtagcaaaaaggaaaagcagcaagtggctccagccaagtggtggtgataagggatatctcatccataaggtaaaacagatgggactgactaaaacaatgcaatagtcttgatcacagaacaagcaagagtactcacaaagaattaattggaggtttcgtcatgacactgacttattctaagtcagcactggaaagggaaaaatccagtttataactgtattctggagaactagtcaggtgtcatgaaaagggatctacatttgtttgaaaacaaacaatcttgggggttgaaaaacatgaaacaattacaaataaggaaaaggggtgaagtcttgccatagtctatgggtgggaagaaagctgagtcaggtagatatggagtagagacttgattgactgagaaactcaagcaaagtagacaaggcttgaagggcactgtgtcaattaaccagcccttctgtggcaaggatcaaaccctacaatgtggaggataaagtgtcaagcctacaaaattggctctgtctgtcatgagggttgctgcctacagtacttgacaactctgaaggtaaggtccagtggagaaattgattccagctgtctgataccccttgcaatgtggtgacgacaggcaggatctaaaagtatagagaccagttctctagaacaaacagtgcttttttgacttccctcatttaaagcatacttgggagacaccctgtggcttgaaagtagccaactaagacagaaaagctggaaagtccctgaaggaaataatgaatgagtgaatgaatgaatacataaataaataggtgaaaatttaaaaaataaatgtaaaaatccctaggtcctgtacagcaaagttcagctagcaaagacactggtattcaaaaacactgacaatctcaaaccgaagatagttttctatgacatctgagctttgactggttccaaatcagcaccagcctcaataacaggactggaatattaggggatgcagaataaattactccaatacacttccttttacttgttattgttttagactttattttttgtaagactattatttacttactattctatttatttgtttgctttctattttgtttgctttctttacttattgaccatttgttccattcccattattcttagtattctacttcttttcatttaaacttgcttcccttttcttttcctgcccctttccccttttttttttccttaagctgctatttctaatttgaccctaaacaagttttgactacttacattattctaaacatatttttaattatcaatggtgctataaatgctggcatcaatcaattcaaagtctatatctgaaaattgtttggttttattgtatgtgttggaggtttctttcctcctttgagtagtgttaaggattgaaaactcaacagaaggctaattacaaataaaactggaaaacatatccatactgacaagtgtacaaattagaacacaaaaacaaacaaaacattataaatggaacaaagttatttcagaagatcagcatttaataaccaataaaaagatggccaactgtttgaaatgctgttcaaagaattctgaagtacatgtcaatgagaagtttagcaaagaaattgagactggtgctgggagggaggatgatggaaataaataaaataattaaaaatctcagtggaaaccataaataatagaccaaatcaagtacaagacagaacagcaggaattgaagaaaaatctgtattcagacacacaacaacacaataagtaaacacaaccaaaccttttagaacatgatcaaaatgaaactaaagaatacatggagcagaaggaacttaaaagcactgagactaagtcaatgaaataacagcagaaattttctaaaatatcgagaaagaaatgaacatctatacagaaagatgtgtaaaacccaaataaatcatggacagaaagaattgctcctgagcacagtgtagctcaaatcctaacactacaaagaaaataaaagtatcaacatactaacaaaggtaaattcactgtaacatccaacctctcactagaaatttttaaagacaaaaatcttttcaatgattactatatccaaagttatcttttaaatgtaatataaaaactttccaaggtaggcataacataaggccacttgtgaccactaaactacagtatacacttaaaggaaacttacacatagcagaatgatacaaacagaggagctcaaggaaaatgaattttgtaattctatatatgaaaaattaagaaagaagcaactgtgtctacataagttaatgaaagaaaaacagaacaatgaaagaaacaacaaaatataaatgtttttagcgttccatttatgagacagattagccaaatgaattaaaagcaggatcaaattatttgttgtctataagaaatgtatttcacttgaacagaagctaaaggaaaaaaaaaaggagactgaaaagtgagtggaaatcaaaaaagaactggactactgacataagtatatgactgtatactataaaagaaaacaactgggctggagagatagctcagcggttaaaagcacctactgctcttccaaaggtcccgagttcaaattccagcaaccacagggtggctcacaaccatctgtaatgagatctgacactctcttctggtgtgtctgatgacagctacagtgtacttacatataataataaataaatctctttaaaaatatattaaaaatgtaattgaggaaaatacctaaaaaaatattttaaaaaatatttaaaaaaagaaaacaaccaatgagggatgtacaattaattataagtatatatgcattaaatgatggtgtacccaagttcataaaaacaagcactaccagactactgtaaaatccaacctctcgggctggtgagatggctcagtgggtaagagcacccgactgctcttccgaaggtcccgagttcaaatcccagcaaccacatggtggctcacaaccatctgtaacaagatctgacgccctcttctggtctgtctgaagacagctgcagtgtacttacatataataaataaataaatcttaaaaaaaaatccaacctctcaccagaaagtacaatatccatatagaaagtaacaagtcaaaatacagtaaaatacagtaataatcttaactttccaaattaataacttatctgatggaaagaaggaaggaaggaaggaaggaaggaaggaaggaaggaagattgattttatctaaactgtaccaaacatcaaatggacttatttcaagacatctaaaaaacatctcaccttctgcagaataaaccttggcagcccatggaactctctaagagataaaccacatttttgaacattaggcaagtcaacaatagtaaaaattactttcttgtacttaacaaataataagagaataaaattaaaatgcaaaaaaaaaactaggtatgctacaaatacctgaagacaatataatacaatcttaagtatcataagagtaactgaaggaatcagaacagaagtgttttaaaggaataagtcaaatgaaaagaaaacacactaggaaacagcaaaatcatcctcagtgaagtaactcagactcagacagataaatatggtatgtattcacttataaaaaaaaaggatattagcagttaagtaaataataaccaaggtacaatctatagagccagagaggttaggtaaagaggggggatccagtagggatacaaggatctccctagaagagtgaaatagattatacagccaactgggagtagatagggagagtaagcaggtgtggggaggtgagcaggtggagggagagatggggttgagggaaagtgtggtagaaacagctggaattggggaggaaagaatttccatgttggtgtagaaacctagtgcattggaaatgtccttgaatgtatgaaagtgaccctaataaaatggtctagtaatggaagatatagaatcttaagtggccatctcttgtctccagacaaccaaagtgagttgcacttcagttaagtgaagagggtcccatagaaattcccaaacagggctggaaagatggctcagcagttaagaccactgactgctcttccagaggtcctaagctcaatccccagcaaccatatggtggctcacaaccatctgtaataggatccaatgccctcttctggtgtgtctgaagacagcaacagtgtacccacttatatgaaataaataaatcttagaagaaggaggaggaggaggaggaagagggagaaaagagaagaggaggaggaggaggaggaggaggaggaggaggaggaggaggaggaggaggaggaggagaagaagaagaagaagaagaagaagaagaagaagaagaagaagaagaagaagaagaagaagaagaagaagacgacaagaaagaaagaaagaaagaaagaaagaaagaaagaaagaaagaaagaaagaaagaaagaaagaaagaataatccccaaacagcctaagctgttgtcaaaacaacaggttgctacctgaaaactaacagtagagccctactgctaaggacaatatccacactacccaatgaacacggagaagccaagctgctgcctgcatggactcttcacccctacactctacttctttggtgtaggaaggtactctacaagctaccaaaagagatatacgcacaccaacccagccacaaaacctttgacctacaatctgtccttcctgtaaaatatgctaaggcagtaggggcaaagaactagtgggagtagccaaccaatgtctgatttgacttaaggcccactccatgagaagaagcctatatccagactgcttggataactaagaaccagaaacctagggtaaaacaaaaacactacttacgttttaaattttttttttaaatcttaaaaaattttaaagtcaataaaatgattatggtatacacattgtatcagtgcctaatctagttactgtcaaaagaggttttctctggcagcagatggaaacaggtgcagagatggagagaccacagtcagacattacatggacagaatatttaaatgggagctctcaatcaaatactttacagcagagagcagggaagcccttggaagagaaggtggaaaaactttaagagccagaggggatggacgataccagaacaagaccctctaaatcaactacgaaagtctcataggaaatgtcataaactgaagcagtgggtctgtaccaggtatgtatgtctgtatgtatgtctgtatgtatttgtaagtgtctgtgtgtattatatatgtatgtatgtatgcatgtatatgtatgcatatacatacatacatgtactacatgtattacatatattacgtgtattacatatatatgtagtatatttatactacaaatatgtatatacatataatacacacacacataggcacacacgcatgtgcacacaaacacacatgtaaaatagctataggtttagtattgtatggtactccctggtgtgagaacgaattaggcttctgactcttatgcctgctcttgtgactcttttcctcttgtttaccaaggcagactaccatgatagtttttgcttcatcttattgtattttattttgtcatgttaaaaaaaaaatcaagaaaggaaaatatattatgatacagaaaggcatctctaacagtgaagtttcactccttcctttagaaaattcggtcagaattcaaataaaaacttaacaatgcacatcacaatctcagaaaaataagaacaacccaaactacaaactaatacctggaaaaaaaaaagaataaagaccagtatagaaattaatgtactgaactctaaaacacagagttctttctttgaagagaataacaattccttagcccaaataaccaaagaaaggcaagaccaaattaataaaattcaaggttaagatgaggacaaaataaaatgtagtactgaaaacacatgaggtctttagtaattaatatgaaaagcaacatttaaaaagaatgaagtatctagaagaaagttataaattcctcaacaggtatgatctataaaaattatattaaaaggaaattaaaaaaaactaaagatacagaaagcaacaaaactgaagcagtacatcctaccaataaagaaaagcaaagaatagattcattgctaaaattaccagttctttatagaagaacaaacggcaaaaaacctcaaagtgttctaccaaacagggaatgaaaactactaaagccattctacaaaaatattattttgagagttccaaaccaggtaagagcacttagaaaagaacacacctcaaacatactaaaaggctataaaataacctgagactattgttatgttaaataaaaaaaaatactgaagtcatttttctctaatatcagacatgtgacaagggtgttcagtttctataatattattcaatgtagcactctgaagtcatagagaaaacaagaaaaaccagaacaaaacaaatgggaaagaaaagaacaaattatctctgtaagtacacaaaagcattctttacttaaggactctgataaacacttgtagcaaaaagaaagacataaccagggcttttctatataaccctacaaagatcccaagaaacccagagagacagagtgacagagacagacacacacagagagagagagagagagagagagagagagagagagagagagagagagagagagagagagaaatgaatatagcaaaaactgacaaatgagactgcaacagttaaaaggcaaatcagtagtgaagagacaaccaaaataatggaagaaaatctttaatgcagaaaactatacatctaacagaattagtatctagaatgtctaagaacaaaaaggcacgtgccaaataaactgatattccaatcctgcactaaattagccctcttcctcaacattgtaaaactcttctgtgataaaaatagaacaatccaacccaagggcatatgtactggagatctgctttagccccacatctgaggtgggacggcatggggtagggagagatgccttcttctacccccctctcactacctacagcaggtagaactggccctttcccttactgattgaatcactcaggagcacaggtcctgcaaattgactataacagctcagaaaagctggctatggtgatgttgcaggtaagctggatgcaaggacattgagagcacaagggctgatcctgcttcattgggtaagttaagcaggatagtgcttgagagttgacctcggctgagaaaaataactcaactacctcccaagcacagacccagggcctaccccaacatctactccaattatgatctgctggaacttatgaagttgccagttctgcacatccaaaactgcaggatctccatgacacagggtaacaacaggatatccaggagtcctggttgaggatccaatacggcagaacctagaggcctcaaaatagaccaataactcattgcaatgaacatttgcaagtagagatgtgtggacaaaagcctagaaaaacacaatacaaaaggccagtaaataaattcttcccaacatattatagttaaaaaataaataaataaaacacagactaaaggatactaaaggatacaagaaaaaagtgacatcactcataaagcaggctcatcaaaattaatatctattcaacaaaagtctttaaagcatgaagtgtctggatcagtgatccttaaccttcctagtgctgtgaccctttaatacagttcctcatgttgtgatgactcccaaccaaaagattatttcattggtacttcgtaactattgctactataatcaatcataatgtaaatatctgatatgcgggatatctgatacgcaacccctgtggcagttatgactctcaggctgaaaacagctagcctggatcctgaaagatcacaactggtaacacaaagcattacacttgtaaaactttacacaaaaattcaaagacaaatagaaattttccatgataaacagaaaaaacacacatctttcaagaactctgattgtaaatggtcttaattaatcccttctccaaagatacaaaataaagaaaattagaggaaaaatctaccaggtggatgttacaattttagacacataagcaacacagaggcgcacaatttcataggaggaatgctattagatctaaaaccacgtgtcagtctcaacagtgactgatagtgggtgacttcgctacccaactctctccagcagacagatcatctggacaaaaattaaaacagaaactctggagttaagtcaaatgaatgtaatagatatttgtacaacattccacccatatactaatacattcttctcagtctatggaattttctacaaaaatcaactacctatcaagacactgaaaaagtcataatatatgaatactgtaataccatacttctttgtatagaatacaatggaataaaattagatattaacagcaaaagatattacagaaaccatgggaactaaataacacattactgaacaggtgatctctgtgagctcaaagccttcctggtctacagagctagttcaaggagagtcagggctacacagagacaattatctcctctagaaactaacacccacagtttattcatctctgagaaaagcatcataaatgatgcacaagaaaatatcttcaaacagcaaatccctgttaaaggaactcaaagacaatataaacaaatggctgaatgagaactgcagaaacatgtaggtgaatcaagtaacacaatcctgagaaccttaggacacagaggatatctcaacataataaaggaaaaacagaagaaattcctggcaaacatgttaaataacaaatgaaaaaaaaaaaaaaaccctcagagcatccttactaaaattaggaacaaaacaagcacattctgggcctgtgcttgttatttcaggttaatataatgcttgaagtgctgatgagagaaatactgtaagtgaaggaactaaagaaatcaccagtcaggaaagaagtcaaattatctttatttacaataaaatggttctattaaaaaaaaatcctgtaagtagcaaactgtaagaatctaccagaaaactcctacagttgataaacactcagcaaagtaacaatacaaaatgaagacacaaaactcagtagtctttctttgtacaaataataaacaaaaagacaaagaaattagggaaaccatcccagtcacaataacctcaaaaattatttgaataaatcaaactaaggaagtacaagagttgtataattaaattttaaaaaattaaagaaaatatgttgaaaaagcaaccagaaggtgaaaaaaaaccacccatgctcagaatgttgtaaaaatagtcattctacctaaaacaatttacagactcaatataatccccatcaaaatcatagcttgatttttcataaaaagaaacactaaaatttatttcataatacacatgacagaaaaacaatcctgaatagtaaaagaagtgctatcagtatcatcatctatgattttaagttatactacaaagctttagtaataaaaacagcatggtgctgacataaaaacagacacttcaagtaatgaaatcgaagtgaaaacttcttgatggtaagatcagattgctatagacaccaaccacatccttgaatcacagagcatggagacattatgctggtactcactggaaaactttatcacaactggctataatccactgtgctggcaagtgctatataaactctcttgagaataaaggcctcaatctcatccagttatgaaccctgaaggctaaaagtggcctgacaagataggattactaataattgcataggtgttttaggagtaactagccactatatgattgcattaaaggtctactctataaagtggaggccatactattaaaggagccaagaacttgtgaatagataaggtaataggccctagggtagaacccataccattactctgctaaatgcacataatattaaaatgactcctaatgattattgctatatcccgagaaaagcccattattttagctttcactagagaagctttgctccgtaacatatggcaagtaacagagatgatcctattccaaaactggtaagcatggcaagaaaaagaaagtgttaagtgctcaatcccaaatcagacatttatctcaccccaaagagctggaaagatggtcactcacaggtggtaaataacttcaaggaaacagtcttttccaagagcaagagactagatgcatatatgaacttatgacaagtcattacgataatacacccaagctacagccagccaaaaccccagcatgggggggtgggggtagagatgtcatcctaccacaagtgtcttatgaacccctggtaatctgactacacactacagcaggtcccaattccaagactagcctgacaatgcaaaactagactcaatggagaataaaggaaaaaaagtttgaaaaagtataatcttaaaataatggaagggttgagagggctgtaagaggaggagttgaggaagtgattatattcatttagagactagatgaaattttcaaatttttttaaaggaaaaaagaattttgtaaaaaaaaaaaaaaattaaacttcaacctcttgaattgttgaccagtgacatcccagtgatcactctcttccaatgctggctatttatttccatagtttttggttactctccagaacttgacagtaagacactactactgaagatataacacacttcagtaaagaaatggaaaaattaagcaaaaactcaccttgaagcttgatctctactaactaggatctgtacaacttgacaatgctatgcaaactatctgacgagaaaagtaatcaggagatattcaacttataaccaaccaatggtccttagttatatcacagttcattcccaaagtttccatatcatttctgtggtccaatagcaatcactgactccactattccacactaactatatatagtgaaagcatgacccaataactaatccttgtatcttccaaaataccaaattacagactcaataatctctaatttctcttttgttattgcttactttttttagttggtattcctctagttatttgactttgatgaaaaacttctcagatttcttctccatattagaaggctaatcttaggttaaagaaccttcaaaggttcaatctgaccaagagtatgctcaaaaaacccagaaaaatttttgaaaatagaaccacctataattagagttcagtttcacacagaaacttaaaagcatccgatcttataaccagaagtcaccctgataaaaatgttcagctctcataaaaaattctgaaaaaacattcaaggatcaacaaggcaaagtgatttgtcaaatggcatattcttaagatgttatgtattatccctcataatcacaggctgagaatatgtaatagttatttagaaataaactgctaccacaatatatttctgagacactaaatatttttcatacatttaatgatttttcactaacacttagtaagcaagcattaactcattaactaactattccttatatattttgctacgtattcaaggtagctttagttgtgaatttgatagtctaatgtgtagtgtgacctaagggactctcaattgagggactacctagattaaactggcccatgggtgtgactgggggaaaggggaaggtcttgattgatgtaagagggaccagtgtactgtggataatagcattccctaggcaggtggttttggactgtaagtaagtggtgttagcaatgcttaggtctgaaaattgagtcagcaacagtataaagttcctgccctgactactttgaacgatggcctataacatgtaagctgaaataaaccctttactcccctaagtttctttttgttagactgttaaatataaacagaacattaggttcccattctactgagaccttaaaagaaatgaagtgatactaaatctcagaaaggaaaatagtaagaattgagaagatgggacacaatcatattttgatagagatactcagaaaagatacctatgacaggcattatctaagaattctgaaacaagtaaaaaagaaaaacacgtagattaactcaagagggaacagtcagtaagttccagaactaaaacctcaaaagttgcaggttaagaacataatgctagtacaggatgtcacataaatgaaagagccagttcagggctgtatcaatttctaaccatagtttaagaaataggaaacctttgaaaagttgagtatagaaaagatggcttaacttttttttaatcagaaaagcccattgaattgttggtagtaaatagaggtaggaacaaaagtactgagaaacaatgatgtcccttatcaaaagatggcaatggtactacaaatgctttttaaagaagctgaaatgtattctgaagataaatgcaacataacttgcaaacagttccaatatgtgacacaaagagaaactaaggatgctttctagaatttggtttaaaataaagtcctactaaataagatgcaaatgtctatcagatttcaagggattgatagcatacaaataacagttctattttggatgaattgatttctggcttttttggggggtggtgtatacatgtgttgtgcacacaaacatggaggcatgcatgcccatgcatgtgcatttggagaccagaaagcaaaggcggtcataattttctaatgctcctcacacaattttttaagacgtggtctctccctaaacctgacacttgctgaattatctagactgaatgaacacatttcaaccaccattccatttctgcccctccaccaaggctgggatgaaaggccttgcctcactttttacataggttctgaaattctagtccacatagttggaaagcaggacactgagccaactctttaggccctgcttttagctgctttttgtgtttgtttgtttgtttgtttgtttgtttaaagccatgatctcatgtaactttgacttgccttactgtataggcgaagctgtccctgaataagctcccaagtaccgggagtacagaagtggagcaagcaaacatacccagccaaatatcaaaattcttaatacttctatatgcacaaattcataatatgaaattttcatataatccacctagatatcttctggttttctttcttcttctattaaactcatgggctaaaggacatcaatgtcaatgtgcatgttatatcccagtattaagagtctccaaaattatttgtatttcttaataagagaactttacaatctctttatttccaaccataactcctttatcttaagcataataaacaccatatgtaggattattaaaatgttattcgtctgttaaaaacactcactcatgcaataataattttaatatatgaagacacggctgtttttccaaagtttttattttcattgacaaataagaactacatatattatcatatgcaaaagtgatacatcaaatgagtttataaattctaacatagcacttttgcacatatacttaatagttgacttttagtgatattcaagaaaatatacagaaagaagtcaccatgctctacaattttggtcctgaactacattctattcattttgcattttttatgtctatcatttattctactctaagtaacaaacaatttttagaatgtttttacagtctatgtacaggaagatgatgcactacctgtttttgtgctgatttatttcattgaaaatataaaggatcatttccatccatgttgtcaccgacataagatttcagaaaaaaattttaatggcgaaaaattacatcatcatatatgtcaatttttatttgtttagccactgacaaacactggtttatttctgcattttgtttaattaatgctgcaatcaaaattaaactgcaggtatctcttataacacactatatatttctataatacaattgctaggtcattgcaatttttaggaacctgttattttccataatcgatctaatttacattccaaacaactgtgtacaagatttctgtttgcttacaacctcaccaacatgaacattcatatattctagcaggtaggaagtagtatctcactgttgtttcatttcttagatgattagaaaggtaaagaattttttttctcatgaatttgatgctggtcatggtggtacaacacctttaatctcacactcagaaagcagaaacaggagaatatctgagtttgaagtcagccttgtctacagagcaagttccaggacactcaggctacacagagaaaaacttgtctcaaaaaacaaaaataaataaataggtttttcctcaacacagaaaaagagcaagaattgaaatatttgagattctgcaaagaatagaggaaaagaaaaaatattataatatcaaaataatttttaaaaactcatttaaccactttgccatttgtactccttttttcccctgtctggtctataccaccttacttgtcatcctctggactgtagtccagttccacattctttcaccagcatagagcttaccaatcagattagccccatggatcctcctggatcttcctccccagcaccggaattttatgtgtacactaccacacactgcatttttatgttgttatgaaagttatcaaatcaggtccttatgcttcttaggcaagcattttacctactgagctatcttcctaccggaactacttgttcagaagcacctatttaggtcccctatccacttcttccatgagctgtctgaattacacatttcataaagtaactattcagcatgtgaatgctttcattcattccataggggggttatctgttaactatatcttttcttgtgtagaaagctattgttttgtataaccccattagtctattttttgtagttatgtttttaaaacaaaatttacaaacactaattaaaaagcttttcctgttttaatatattaggtgatacttaaaagaggatattaactaaggacacaactttgtcctatttaacatactggtttttttattctgcaagagtggtcagtgctcctaatagctgagccaccttgcagcctcaagaatgcttgagtcagagagtaaggcaatatggcccctgtagttaggcagacttgggttttgattttagctgatgttgtttcttttggggatttcaagacagtgtttcttgatgtagctttgggtgtcctagaacttcctcctgactgtctctgcctcccaagggattaaagattaaaggcatgcaacaccaccatactgggctaaaataaattccacttaattataatgaataataattatgtattgtttaattcagttggttattcctttctgaagaacttttgttactagcctatagtactagacttttgttttcatatgagagtaatgacttaacttatagtattagttcttcaaggtttagtgaatttcatcagtgatatcattaggttctgggctttatgtgacaaaagacttaattcctgatttttccatcttctgatgacacaacattctcaactctggccatcaataatagcatgcaaacttaaaatgctctaatgctaaaagtgttatacatgaaacactactaatggtttgtcctatctattctgctaatattcaatctaaaatattatctattagagactactggtacagtctaactgcaagcactatgaggtttctaaactaagcaggccattcagtgcatgaaactttcaacatttggtctgtttttttaaaacccttcatatcttggtaagttttcagtacactcaatctcaactcaattataactatagtgttccacaaaacatcattaaacctttttcaaaagaaaaagaaaaagaaaaagaaaaaggaaaagaaaaagaaaaaaaaagtacatggggagcaaagatgtggtggcacacactttaatctcagcgcttaggaggcaggggcaggccagtctctgagtttgaggccaaattggtctacagagccagtttcaggacagccagggttaaacagagaaaccctatctcgatggggagggggaaaaaaggtacatggggaaggcagttctttagtttctactatacctgcagctatctaggtatacaaaataaacgagttttcttttaaacaacaacaacaacaacaaaagttatttggctactaaactacaataaaatataacctcacatccattaggatgactattgttccccaaagaaattttaatatacgggtcaagttgtaaaaaaaaaatgtataaaacttttattctaagaaatgtaagtaaaatggtatagctattgtttaaaacagcatgatatattctcaaaatattaaaaatacaattaccatgatattctataggaccaaaagaatttgacaaaagattagacccatgctaatcacaacattattcacaattgctaaagcacagaattaacccattaacaaatgagcagaatatagcatatacaagcaagcaagtgttattcagccaaaaaaaaaaaaaaaaaaggaggaagttctagtatatgctacacataaacttcaagaacactgtgttatataaaataagccagtcatcaaaacaaaacaaaaactgtgtgactacacttacttgagatagttagaagcaccaaacccacagacaaaaagtagaatttaattgccagccacagtggaagaaacaggtcactatttaatgcatacaaagtttcagtagggcaaaatgcaaacagttctgatgacaaatgctcaaacatattaatatttacaataccactggctcatatactttagaacaataaagagtaaattttatacattttataagtgttttaaagttatcagagaagttacatggtctcaaaaatttaaaggataattcatagttgtttcttaagacttcacaatgtacttaagcatttaaagggatgtaatctgcttctagtaaggaaaacctggactttttcaaccacaccttaaacatagctatacacatctatctttacttcctcctcatttcttaagacaggaatgcatatgtgtgtgcattaacatagatggtataggtagatttatacatgtagagaggtgtgtttagaagtcagaggcttgttttcactatactcaaagcttgtcaattatgctaacctagcagccagcttgcctcttactccagtcttcttaatacttacatagcaagtgctatattcaccaagtctttgccacagtcccctgcttaattccttctagttattcctattttcatttttcattcctcattgtcaaattttgaaaaggttctcaatttcctacttttccctacactcaagtgtcttgcttcagaaccttggcaatgacttggcctagaacactgttcaaatatccaactgcttaatccccagtaacatttcaggattcaacctagttttactcagctataccaatgttcctactatgcactagatttcttttgcataatttggtactcctctgtattcccactgtataccaagtataattctatctcaataattaaaaaatctgattctgctctttctgaagcattgagatataagtctcaagcatctttatacccaaaacatagcacctgatgattaatatttagaacaggggtcatatttaaacaatcttgctttcaggaattataaattaatagcaggcacatagatgtttgaatcttcctctaattcccctatttatcaacaactgccaagggcacaaaaaacattgaaaattcagaatcatgtatgtaattatctacttaccattagacatctaattttttgcagaggtttggaagtatttggttaggagatataagtagacatgttccaatctctagatacaatttaaagttgttccttctttttctttttttaattcaattttacctttttttattttaagcctgaaaggtattttcaaataaaatagtgtagggcaacttgagacacaaaataacctgaacgaagttatacttacattcggctagcttcaatgtcctcagactgggattctcctggtgatctgtaaaatgtaattaaagacaaatattagtgatttccaaaaaaaaggtatagaaatataagtaaggaagataaactggaaaacaagacttaaattccaatgaaagggtgctttaaaagatttaaaactaagaaaaaaaaagtagaaagatcagattatcacaacacatttaagaacaaattttagaaacctcaatgtttaaaaagaaaattaaaatctttatatttagatatcaaattagtataagccataattatttacaatgtcaaacacatattaaaaaacaagactgttactttctattaagttgggttgtggtattcatagtcttgaaattaaatgaagtgtttgcaaactgtaacctgagcaaacactaaggtgtaggataatcacctttattttgaagtgatattatactgagagatttgtattcatttatacactgtctatgtattcagaaaaagcaaggataagtacttgcagaaaaaactatttccttcaaaacctaaaacattataaaaaaaaaaaatcccttgaaaaatgtctgccaatttctgcagtagacaatttaaactcaaatataacagtgttcatagatctttaagatatttaaatgctatgcaccattctaatcataattcctgtggttctataaggaaattagatttccctaaaaagcactatctgccgtcaccgtgtatatggagcattatgtttgctagataattgtaggctagttttagttttaatatctgctggttattttctttattttttaatatattagctaatatagaaatacatataaagcaccaaagagtatcccatttttattgggtggaacataagccaatttccctattctgaacatctggttaaagaacaaattccagtgatgcacacagcaatactttgctatacttcctgtcatcagaatgctaaaccaggatttagcatgaggacaggctgttctacatagtgagacactgcctcccaaaaagaaaaaaatctgttaccctacatatctttactgtgagacaatcaatgttctaaggtaaatttattttaatacctatttctaatgctttaaattcccaaaataggttaagaaagaaaagaataatttaaattttcaaatttgtatacaaagacaatctgtgaatttactactgactttagtctttcaagttaaagacttgatttgtaaatttatcactgacttcagatattcaacttaaacaaaaagtttataaaaggctggttgtggcttatggttatggaagattttttaaagcaatgattcttaagttaggggataaagaagaggctcactagttaagagcacttactgctcccagagaaatcaaggtttgcctcttagcacccacacagctgctcacaaccatcacaaactccagttccagcactgatgccctcttctggcctatgtgagtatcaggtgcacatgtgcatctggtacacacatacatacctgcaagtaaaactcacacacagaaaatttaaaaatcttagccaggcaatggtggcgcacgcctttaatcctagaagttggagggcagaggcattggatttctgagtttgaagccagtctggtctacagagtgagttccaggactacacagagagaaatccctgtcttaaaaaaacaaaaaacaacaacaaaaaatcttaaaaattaatgtattcacttctttagtgtcaaagaaatttcacttctttgcttgactttcaaaataatactcattgtaattcatttagattccaagtcagtaacacacacacaaagaaaaaggaaaaaagatacgattaaaaacagaccccaaaagctcagacagtttagattttcttagtagtttatttatatttttctgtttatcacaaaattacataagaattgaaaaatgtagattaggagtgatatcaaataaaaaattctccaccctcttcccccagaaaacaagcaaatatctcagaaataatgatctctacagccttaagaaactaccaagattgtttccaaacttatatctcatataaaatggctagaagagttaaaacatgatggtaacccatgcactagctaactcattttggaatgtgtctttccaacatctcatatattattaagactgtgagataaagctgacttgcaaaacaacaacaaaaacctgttagcaattaggaagccaaattagaagtctctaaacaggtaggaagcaaagtgttctaaatgtacaggaaaagaaaaatttagagaaggttaagaatgatgagagaaaaaatattatataagaaaatataagataagagaaaaaaagaactatatctcaagagaatattatagaactgctgcagtttcaagaccctaaaatgaactatagaacaaacatattgtcaaatggccaactacagctattttcgcaatttctgattgctacagagtatgtgaatgccagtaacataatgccaaccaagtattgtaaatatactagacttctatttaatattcacaaatattagagtaagttattaagcaccatttagccaaactaaaatttaagaaaccccagaaagatcagagtaaaattaatccaaacaaattattcttcttaaattatactcttcttgatctcttagacatagtatagcagaggctgctcccattcaaacagttttactttagtcaagagaaaaatatataaatacaacaaaagcatgtttctgatcattgtgtacatctgaatgtctatgcagacaattttaataatattctaattaagttgccaaaatatatcctaaaactagagttaactttcaaagtaactctatttttataactattagtaggtgttacaaaccacaaagtatatgtaacacctactaatagttataaaactgttctctgctcttaaaatgcttgctgctttttactgacaatacatttgaaataagaattcaggacatgctcctaattttaccaaattcaaaatatagaaccaactaaaagttaataaaaaatccactaccaacccaagactgacccaagttatcctaaagtttaccagaatattaataaaggaatgaatgaaatttgaaacctgaaaaatacctagtaacaatggtgaggaaaaagtcttttaaaagtatcaattttaggtattaactttaaagacagaaaatgtaatcacaaaacaaataatctgaacactggaacatgacctagtaaatccatccttttaaggaggtaaaggtgcacttttaactccactgtaactctctaggagaaaaagtacactcattttactaaaggtgcaacatttctggagaagcactgaaactcctgccacataaaatattaaaaataatacttaagatattttccacatatctcttaaaatgtccacactgtaatcttcaaaatacttaagacatattttcttattaatctatgcagaaaaacaggtctttgatgattacttatcttcatgaactgaagggtaagtaagaaatgcactataataaatatctgagaaaggaggttaaatgaagaaatggctccgttcttaggtcttttattcttagcaatattcctgctacctatgcatttttgtcatttttatagcacataattcatcttacaatgacagcctttctaagactgtaaaataacattcaaaattaccttttacaagctgtggccattcggtgacatcagggtgataacagctttgagtcactgattaaaaacaggttgtcacaccagtctagctgctaacttgatctgaacgtaggcttaataattctaataaattaaacaaacctttagttagaacactagcataaacccaattcattgttcaagtcattatcttcaaagctttaaatcagtagtcaatataaaattagaagaataattatcacaggaaaacctttatgaactattcttcagtatattgttttcttaaatggtctcttcatttgagaaaatgaggtatattctcaatccaaaactactccaaaatccagaatgttttaaatcatcatggcagcaaataaaaaagggctggatttaggaatatttccgattttgaattttcagactaggtatgttcaaacagtaaagtctataggaacatgccaaaatctgaaaaattcttaaatttgaaacatagtctggtcccaggcatttctgataaagataataatccctacttttcaatgtagtactatatggctcacaaaatacaacaatcaactgtacccttacattccactgactttagctctacaagatcaaaatagaagaataacaataagcagcctcagagtgattaactgacttgccgaagattttgtaaataatgttgaaattaagaccaaaaaaccaatatcagctaaatttccactaagtattagaattttgctatggtttagttttgctttacagtgttttgtaatttaaatacatacaaaaagcaaaaatttagactatgtattgtggcagtaattagaatgaaactgatttagtatcaagagtctttaactgatgggagaaatcagctaccaaacaggcaaaatcttgattaaagttttacacacacacacacacacacacacacacacacacacacgcacccacacatgaaagagagagagagagagagagacagagacagagagacagaaattatttaagtagtataatctatcattaacttttagacctttggatctataagaaagcattcgttttcaatcccactaagactcaattctaggaagtaatataaagcaaaatatgaatgaatatcctattattcacatatctgaactatcatatgtgattttaaacaaatctgattcgtttcacagccctccttatcatactatactcctgacaaaatgccaatactgttatggttttatccagttttcccccaaaatcctctttcactgatctataaacatagaacaaatttgaatgagcttaaaacaaaacaaaacaaaacaagaaagaaagaaagaaagaaagaaagaaagaaagaaagaaagaagaaaagggagtgtaagattaggaagaggaagccccttcacaattaacaccctcaaattgacagcacagacaagccagatggctgaaagcacggaatcagaacccaacttaaaacaggaagtagtgagaatcccaaaggaattattaaagcatcaatatttgaacccatattattgttagagttggctcaagtttatattatatatatatatatatatatatatatatatatatatatatatatatatataaacaaaatcagggggtcccaataaataggatttataacccctgttaagaaataacccaatttcccaaatttccctatcataactatttatcttctactaagaacagaggcatcactgaactagcaagggagagaaataacatccttgaaataaatgtggtccatggcatagttcccttagtttctcatcaaacagcttatgtggaattatgtgaatactgaaatgaatctaacttctaacttacaaacacaaagataacacagcttaaataaaatcaactaattcattaaagaactatatatactcttaggattactaaatcaagtactctccactagtctcctctttattaggttcaatgttcagttgaacagtttccaaagacattctaagattccactctccatgatcacttactatagggaaatcttggacaagttacataacctctctaaacctcaattatcttaaagcagaattaaaaccctagtctgggttatcataagagtgccttatataaaatatgtttgcaaataaatgaaagagatttttcatacccacagcctaacagccaagtctatttccttgaccttcttgttcatattactttgtctcataatacagtaaactcacaaattcttccaacaccccacttatatccctcacagtctacctggttgtatactcagcacctagtaagagtctttaaaattgacaggcgcccaaatttattgaacgcatttgtcattatactagccgtaatattaaaataattcatgcaatatgaatttcaaaaaataaaacagaaacataccatatttcgccaaacttctgaggagctggtgaactctaaaatcaggctcttagagagattttttaacctaaaatataaaacacctcactcaattcttttaacataaactggatagtctttcagaaaaaaaattactcaaattcattataaaataaaagccaatttctcttcaataatacttataaagatccaaaaatatattgaaagacaaattaccccactcctattgccaagaaaagtagcagggtagctctgtaggctgtgagctgaatattttccgactaggaaagccatgtttcccatcttcatgtacaaaaagtaatgctccacaatccctttcctcaaaccccttcagatatctacagtaagtccacttccaggtaatctctatatgaaaaacttctgctatataaaacctagagtagcaaccatggctaaatcctctgacctgtcagtctctcaagagtgctaagttgttgaattagagaaaatgtataaaaagaatatagatgctttcctgacacataacagggctctgttactcaactaagtcactccatgtctatcacaattctttacaaataaacaataacaatgtacttattacagagcttaaaacaagctctcctatgattttaaatttgtgttcatagttcatttataacttgtcttgaatatttttcagcctttaatatcttttaatcttattttgtcataaggagaaaacctaatcctatggattaagcaactacaaaataaataaatctgcatattatttataggtaaataggttggcaggtaggtgagtgagaaggaaagaaggaaaggcaaatggatgggctgataaatgatggatgggtgggtggatggacagacagattaataaattgatagatggactgatataacactatggtctccccaaagataaactttatcacatactagtaaatcctgtggcataacagtaggattctcgttccaatgactcaaatcagaaaagttcaaatcatcctgccaaatataatatattgctcactcactgctaccaattccacctcagggatctccccacaatccaacactatccctaataattctccagtggcctttacttgctttcggtatagcttaattgctccatcacaatatgtaaaactatgtttccaaaccctgctagtatacccttccttccagactagacaaaacattgagagtatgtccttaatttttatactaaatgttttaaaaggtttatagaataaaacagcacagaaaaaaaaaaaaaaagaaacttgggtagctatgtaaatgcaaggctaagaaacttcaatctgtttcaaaagactatccatgtccatttccttataaaccagtctaactcaaagtcacgccggaaaaattagctttaaaattcttttttgtaatatttcatctttaaagaaagaatccattgcttcttttccccacatggttactaagattgttgtgatacagagtcttgtcattttacctcatttctctcttacatatttgacagaactatcctcctagaaattagaatttggtcatatccctctcatattaaaaaaaaatccctatgccttctcaattctgttaacataaatttcaaacttttttttacatattaactgatgtccttgtcatatggtcacatccagtaatccaaacattacccatatatgatgacatcctgaaatatcaatctcccttggttattgtactctatcatatatcagaaatctctatttctggtcctaataattttgcttctcaggatattccacaagaaatgttttcctgtgctctgcaatttccatcctctctttatctataaaagcctatttaaaaaacaaacaaaactattcttcttaaaactttagagcaccccaaatgaacaatgacagttaaggactgagaatgacaataacactaacaatgaaaaaaatcagaaccttcacatattactaataaaagtatttcaaaggaatataaatatatagccactttgagaaaagttttaaaatgcctctagttttaaatagttgccatatttcccagacaactcacacctagatatataatcaagagaatgctatatatttacaacaaaagttaaatccatatatatgtatgtattatatattatatatctattatataatatataattatttatgtgtgtgtgtatacacacacacacacaaaataccataacaacccaaaatgaaagcatacagaagcccatatactgatgactggacagataatcagctatttaaaaaacaaacaaacaaacaaacaaacaaaaaaccaaaaaaaaaaaagaaacaaaaaaaaaaaccttgtagagtttcttttcttttaaatttttttctgtaaattataaaacacacagaaaattgcttagcatacagcaggccctggatttcaaactccagcacttaaaaaaaattaattaaaatcattaaattgaagcatgtagaaaaaaatcataaaactcttatcattttaccaaccactcagaattaaagcaaacacaaaagatgccatttgatatcattatttaaaatctaactattccaagtactggttagagatgctagaaacaaaaatgttcattcactggtgatacagtatatgttggcaaatcaaatttacataaaatttgccgtatctaatcaagttaaggatatatcctattttctaacaacttcatccctttaattttccctaaagaaaaccttttacaaaggaagtataaaaatgatctgcgcaatataggaagcaattcaaaatattcataagcagtgggatacaatactatttagttatccatatactataataccataaaagatatgtgtcaacatacacatctcaaaaacagataaaacacataaaataaaacacataaaataaagacacataaactgatggcaagtatgtatgaaacacatctataaattcttaagcatgatatctcacttattggcaaaggtcatatttaagtacaaaacagaagatattcaagaacttcaagaaatctcttacatggataagaagagagggtattaggacttggaggaagagattaagtttccaaaacaaaaatcaaaactggcatttatattccaggatggtaggtaagtagattattgatatactattaagtgctttaaatattttataacatgttttaataagaaacaatctgaatatacaatttctaagctaaaaacaaaaccctaagactatggagacttccatgacacaatcttcccaatttattaaaagtatgctaataagataaaaatgtatggctcttgagattatctccatgagtaggataaagccatataagcctgacactttaaaaaaaaaaaaaaaacactctgggattaaagttaaaaattgagagaccttaatctacctaactatcctctgacctccacccgcatcacagcatggcactcttatgtccaaatacacattatacaacacataatgataataatagtaataataattcaaaagattaagacaaaatataaaggactaaaggactagaagaaatgttccctgggtttaatgccaagaaccccccccaaaaaaaactattattataacatgataattttaagcgcagaataggtgtctaaataattaagctattatctcttgaccactaaaaagacgaattagtatcaatttttaaaagaccttcagaaggtctttgttaattgtccaggccactatagtactgcttaattctgtttacctttaaattctcaagcctagagaattatgtattaccatacatacatatttcaagagcctacagcagatatcctaacccagacctgaacaatctagaaagtagttcattcaatccaacatttacaaatacctgcatctgcagaagggaaaggaaaaggacaaaagggagagaacagtgagagaggaaagaactgggagacatgaggttagaaagagagaaaaaagagaagaggaaagatggaaaaagggagaagacaaaggatacagaatacaaaatgtgtacacaaacatttactgttctcccagactcttcagtataggaatagacatctaatttcaactggttaagttatgtgcatatatctgtttttacgttcacctcttccctgtgtttcatttaactcaaaaaaaaaaaaaaaatggagtaagagaaaatttcagaatcagtagaaagatgatccatacaaagttaaatcagaccaaaacaatctttcatttttaaagtgacatgaaacataatgtaccagccagtaattatacatgatgttaagtacagataaaagactaaaattagctcagttctcctactatgctttaagagctcttactttaaaattatatagcccaatctgtagaggaaagtatattcctcctttaagttcctaaacttgtacataacttcttattcccatctccagtctagaatcctgtacaatgttatagaatcagtgagaaacagtaacagagaggatggagaatgggacagaatttccaagcggagaaatttcatttctttgaaactaaggatttggattttcttaatgtattttctatcagtaacacatgatacagagtcaggtcacttcaaaagtgaggacaaaaacatattctctaatgagtctttatctgaaataagatttatctattattatacatactatacaacaggtactcaaaaaacaacattttaagttaccaaacaaaaacacatttagcaaaggcaaatattatctttatttttagcatattgtacgcttagcaaatatatctacacaaaggggcatagtaaatagaaatcttaagggagaaatactaataaattgaggctactctacttccccttaggatgcactaggcattatttttcttaaaaaagaaaaagaaaaagaaaaagaaaaagaaaagaaaaaaaaagaaagagggactatgcatttcatcttttcctttccaaaaaaatagcagtatgattcacatctgatactaggtaaagtgctgaaacctataatgagaagagtggtatcaactaatgaaaacaaggaatgagtttcagaaaagacaagaattcaaggaaataacaaaatataaagtttgttcaaactaaatggtacattacatggttggtttcttttaatttcttctatattgttcatatcttctatatttaactagaggtatcagcatttattttatatcacagattataaaactaaattaattatggccatggttccacaatggtatctctaagactactttttcatatcagaaagtccattagaagttttaagtgaatagccatctcttttattcaaaaaagcaaaaaaacaaacaaataaaaaaaacataggtttttgttttaaaaaaagaaaaattttatcacattaaaacactgttctgtcgggcagtggtggcccacgcctttaatccctgcacttgggaagcagaggcaggcggatttctgagtttgaggtctccctggtctacagagtgagttccaggacagccagggctatacagagaaaccctgtctcaaaaacaacaacaacaacaaaaacaaaaacaaaaaaaacaaaaaaccaccgttcagaaaagtacaacactgacagtatcttcattcatgtcatagctatgtaatttgtgtgccaaactgcttgctttaaatgtccagaagaacattctgaattgaagatatatgcattggacaccacacacacacaaaaaaaattggttcacacccatagtccccagcactggagcagtgtaatcagaaggataagtaggtgaggttatcttcaactactaagaaattgagaccagtgtggactacaagatattctgtcttttaaaaaaacatataaaacaaacaagaactaaaaagtgtctcagcacttgggccgaagaccaagaattcaagggcagtctgcactacatgtccagatacagtctatcctaggttacataccatgatttttatcaactactactactccgccgccacctccgccgccaccaccaccactgccgccacagctaccaccatccatccacgcacacacccacacacataccccatcaccattcaaactagatttctaaggctccataacatatttttttcaaagtatttttttcaacctagtgatgtagctcactgctaggtagcaaggccctgtattctatccccagctatgtaaaactaaaattgaaggattttttttaatatctgatttctgtcaaattaatgagagttgtgctatactgcttaaatgatgttgacaggtaagaaagaccaaattctgaaatgtactgagctgctgctaagagtaacaacagattacacacaaggttatgtgtaaggaaaattttatcctgctcatataaaaagttcagtacctatatactactactactactactctggtttcactcaaataaggatgccagcttcagcaagatttacataggattctccttcataagcctaatgcaatttcttcgtgaggcttctcctcagatttgctacaactgaactgcaagaataagcttaactatggtactatggcccctaaaggctaccctttcccatcattcttataactgattcacttgcaattcatttaattaaaaatcaggtcaagaagagcaaatgacaaggaattcagctttgcaaataacttatcactaacaatttcatgttaaatgtacattacttatttctaggttttacctgaagccacagaagtaataagtgcttcagaacttcagtggtttaggaaacaaaacaacctaagcttattgaaatagttatcaaatctgaaactaattcatatattgtaattgcggctgtaaaggagatatacccctgcaatcccagctctcaaaagaggtacataccagaaagaccaggaggcttagccatgttaacagaaaacaatataaccgtattccatcatcctttctcctacaaatttcctgggcaagttactttctttatacagtatctatcaatgttcaagaagtatcacatatgagcagcataatcctctgtaacaagaaggcagtaccactttaatatgattaacaaggccttagaaagataaatggcctgctcctatttagctcactctggctcaagacagatgtcaggaaagcagcaacttctgacaacatgaatattgcattctttattccatttcaataatcctaagttgttttgtttcctaaaccactgaaattctgagccatttacttattctgtggcttcaggtaaaacctaaaagtaataagtaatgtatattgaaacctctttcaaaaatcagtataaaaaatttttttcatgtatagataggcccaatacttataatctttccaaattactattcattagtttagttgttatagacaactgaaatcaagaaagtataggtaatattttgaaattaaatgaaaacaaaggaaatctgatgtgtacattaataagtcactttattaagaaggaataagtgtcatgtatttcaagcctttcatggttggaaaaagaaattgagaaaaataataatatttctacttaatacaatttatttcacatcttttatttaaaagaattaaatcctgtgctatcttataaggattatattttactaatagtataaaaatatataactccataaaagtgaattgctaattgcaaaataagtgtagctattcttccaaacaaacatctctgactcttattattgaatcagaatggtaatcattgtccaaataaatgagtcctaacaggctgagtagcatactagactaaatctatttcattttatatataccacatgtgcatgtgtactgtaaaaggatattgatgggctgcaagtaagacatgaacacatataccaaggatacaaaaaaggatacaaacagtatcctttacaattgtagctaaggggttaagggatattaagtctacagaactgccctaaaactggaggggcacagacaattaaattccataacttaacagaattatcacattaaaaaataaaatggtgttatgtgcaataaataaccaacctatcagtttccaaatgatagatattttctttttttttaacccttataacccatgtcagctcacacaattcaaaggagcctcagaaacactacctgatactgataactatttcagacatattcttctatgtgatctgaatctttgcacccccccaaaaaaaaacttcactaaaagcctaaaatcggaggtgatgaaattacaagtgtaatttttaggaggacctacattgatgaatgagagcaatgtcctaattttaaaagaccatttagtcttagctgaagcaggtggatctttgagttagaggccagcttcgactatttacctagcttcagaggctagtgagagacactgacacaagaaagggaagcggggaggggaaaaagacaaaagaaaaaagaaaggaaggggagggaaatatagggaaggctggagagatgattcaaaagttaaattaaaagcacttgttgctcttccagaggacctgggttcaatttctagagcccacatggcaattaacaactgtctatatcccagtcacagcagttccaacactctcttctcacccctacagacaccacaccaatgtggactctcatataataaaatcaaaaaaagaacaaacaaaaacaaacaaacaaaaaccctaataaacagagacagagatacagagacatagtgatactggcctgcaatcacagctcctatggaaggcggcaggactcccatttcaaggtctgagctggagtgtgtacagaggactaggaagtggtagagcagttcctagaacttgagaggccctaggttcagtccttagtcctcctaacactactcaaatttacaatgaaaattagttctgatcttaagatttctcagtgtccttgactgtgagatacattttttggagttggggggaaggggggtgttgaccagtctttggtattttataaataggccaaacagacttaaggattctggaaacatagtctgaggccagcctggtcaatacagctagctccaggacagccatggctacacaaagaaaccctgcctcccaaaaatattaattaattaattaattaaagaaaaaagttttcaattacacattctatgacatctctgattgataacttttttgagacaaggtctcgcctcttagtctaggcttgccacaatccttccttagcctctcaattgttggtttacagatgtgagacatcatgcctaacataacattgtctttatttttatcagtaagaaaaagtaactgtcaaaaccaaaactctattatcctaagcctttctgaagagaacatcaaaagacttagaggactatttttatatttttatattgtttttccgtatttgaaagtacttaaaagaccacctcttaaaactcatctccagttgcaaaaatcagaacactgatgtttttaatagctgcatataaatataatataaatccattaacagtaatattatcaataataacaaacaaacctaattagaataaatgataatataccagtaaccattcatttaaggtgttggtttttttaaaggacatttgaaaagatcatcttaagctcttgaacagaaaaaaaaatagctatggccaattaaaaagaaaatgttcataaaaattgagagaaacaattattactgcaattatttgagggaagacacaaatgtttaagaaatacaactgaataaaatttacatgtcagagacattatagatacctaatgaatgcaatgttaaaaaaaaaaaaaaaaaaacgaatcaaatagaatgagttttgtctcaggtagaaatcacatttttctaatttaaaaccataaaaagggtaaatagccggtcctggtggtatacatttttaatcgcagaaccctggagacaaagccaagaggagagttagacgtcatccagcgatataccataagaccctttctcaaaaaaaaaaaaaaaaaagggtgatggtggctatttcagggataaaaaagccacctacaaaacctgcatacaaaaggaattttctaaactcaaagttaagctcctcagttatatgaagagcaacatccaaagaagtatgtgtataccacttcacaacacaccatgcaaggtaaatattgacacaaattatttcacaacctacattctgattttgaaaacaaaactacaagtcatctcatctttattatgtgctgtatctttcttaaacgatagactgcgaattgttgaagttctcatttttattacagattctgatacatggcttttttgtaaagctaagtatttatggatttacagtcatccttacttaggcttatcagcaatacagatgcagtatccacttccttaaaagtgcagtaagcagtctatttaagaggagaatttaatactaaagcaatttctgtcatacataacaagacaaaattttccttttatctctcctcaattctaaatttacataatttaccaaaaagatatcttaagagtattaactaatctgaggtgtgtcaaaaacattcgtcgtgtctcttgtccaatagggctttgatatttagctttttaacagctgtatttcttaaagttcaggccatctttatttcaaacgcacttccctatccaaaacattttaacataatctgctgcttctcccaaaaccatgggttatacgaatatccttcacgaagtaagataatggtggataacacatcccatatactatttagttaacatttccaacagtacactagctatttaacgcaatcccaaagagattttatactgttctattttagcatgctcaaaagacataaaaaaaattgacgtaaaattgtctttagaggattcttctaaagctgataaagtcttattaaaattatactttctatttttaaggctaacgcaattatagcacattcaactctgattcttccaacaaaaagcctccgcatcaaaatggggaaaacgtccttttcattttctcaactgaaaagggggaggggagaagaggaggaggccaactgcttacaggtttgcattgaaaattaacacagcagtttctgaggaatcagtaactcacgttcaactactgaatcctaccagaagcagcacacgaataaaaccagagcgcaatccttgggcttgaggtgccgcttcatccgtcttccttccaatccacccccaataccccaacccactaagcacacatctaaatatgtcttccccaccagagcgcccctttggaggaaaaggcctgcctttcgcagcctgaagccacggctggctctccgatctctgcttagatgaggcccccgatctcgacgccctgcacgtccgccccaccccgggcccactcgggtacccgtgggtgacaaaaccctccctcctgcgtccagccagcactgacagttaaggctgcagcagccgcagccaccagggcctagtcctggcaccggcccctccagaccacgcgccccaagcactcgctcacggaggcgggtgagggcccggcgcctaccctgtcagcgcgggccggagggtgacgaggggaccggcggtacagaccagagggagcgcgccgggcaggccgcagccgcagcagcactgacctgtcctcgcccccgcgcgtgggctgcggccctcgcagctgcggccgcctcactggtccttgtcgccctcgtccaccgccgccgcccgccaccgcctcgttccctttcgctggcgccaccgccgggtctcatgcgggacccgcgcttctcctcaggaaaccgaggccgagaggccaggcgcctgggcaaccttgaagtcggcgctgaagcgctgctgtcgcgatctgtccacagtggggggcgagggcggcgagcaactccgaagagaagcagaaggaggcgccaccgtcagcgacaggtcgacggaagagaagcgtaacgaggcggtgaacagctgcgtggcccggtgcgcgagcgagagagcgagcgcaggaggggcgacgaggtgctggcaaagacgaaaggccctgtcgtctcctggagtcacccaaagaggagcgccaccatcttgggagaaatacggatctcgcgaacgcagcactggacgagaggactaggtgggcggaccgagtatcccgacag

SEQ ID NO: 4 - DNA, 169170 bp, Homo sapiens
agcctaggtaacaattgtgagacaagaagtttggatttcttagtttccttccattggggactttattttgggattctggcaatggaatcttattgcgaaacttgttttgcacgcttctatctgtgtgcttctaagtaaactataaattctgattctttaagtgctatttaagtttcctacaattcctaattttcttggatatttggcactaagacccttgctctttttctctcattggatgatttagtaagtcctactggcactattctattgagtggaggtgagaggctgcctttgctgactgaaaaatttcaaatagataattgaactagtgaagactgagctctataataattagatttattcattcagacaacatgaatatcacgatagggttttcttctcaatgattgactgacacatgtgatgcaatcctcatgagaaaatccttacttttgccctacgattgattgttttcagggttgagaaatatgatacattggaattttgctcaatgcgctacagttatcgtggtctaaatatacagacaaaattttctgtaatgttagtataatattttaacagtgctaggatatgttttgatcattaatgaatctttatgacttaagggtccttgcaattgggataaaaatgtgagtttcaataatatgtgtttgcccatgaaacttgaaattagataaattgatgagcaatctggtgcctgacttttctttctcaagtacctttggcttcgttttcattatgatgaaagtgtgtgctgtgaataatgccaatggtaaataagacctttatggacacttatatgaatgacagtcagggccgttccttcaggccacatgattatcgttatgcattcttcttctcaatgagtgactagcatacttgccaggatctacaagagggaaactttattttttactaaaattgcatcgatataatgttgacaagttttgtgattattggtatcatctctaagatgtgatgctcatttggtctaaatatagaagttaacatattaacttctaatttatatatgtcaggttgctatgtttttacaatgtttgtggtttattgatgatgactcacaacataaagactatggcattatggctacatgttctaattctgatatatacatatcccatcattcattaaattaaatacaattatgagtagtatgatgtctgttttctaaaatctgagtttcacctggctccagtatgatcattatatgatggagtgcaagcaacatgttaatgccaattgttattgatatggcttccttgaatatgtaaacaagactgatcaattgaaggtcttatttctgcattaaactacctgagatattctccaaattcaagagacctgtatagttagtctttattctgtttgatgaataaatggcctatagcctatctaatggatcagtttttccagtactaatcatatctcttcattaagaaatagcatgcataagccatacatacaggaggtaatatttgtcatcttgatctactgtcttatcctcctccccttagataaggatgactgaggaagagtactctttggcttgttgacaccagcacagctgacacacccagatatctgtttggtctcctgtgaactttcaaccaggatttaaggatgccactctggtaggtattttcagacaaagtgaatatgtgattgtagagttccatggcttgtttcaacaataagaccttatgttgtcttgaggacatgagatgacatgaaaactagactggctggtccttatcttttctggggtattctagtttgagcttaagataaagaaatatatttgggatatagtttctctcacctgtttctattagcttctagaagaccacttatcaattctttcctcctgatttagtggaaaacattttggcagttcctcaaaaagttaaagataaaattaccatgtaacccaacaattctgctcctaagtacacactcaaaagaattgaatacaaatgttcaaatgaatacatacacatgaatgttcatagcagcactattcactggctggagttccagaccagcctggccaacgtggcaagaccctgtctctactaaaaatagaaaaattagctgggcatggttgctcacgcttgtagtctcagctactcaggaggctgaggcacaagaatcacttgaacccaggaggcagaggctgcagtgagctgagatcacaccattgcactccagcatgggtgacaagtgagattctgtctcaaaaaaaaaaaagtgaaggtatgatgacaatgtcacacaaaatagtgaataccaataaaaagatagaaattattaaaaagaaccaaatgaaaattctggagttgaaaagtacaataactaaaatttaaaaatttattagaaaggctcaatagtagatttgaactgggagaagaaacaagaagtaaacttgaagatagaacaatagagattatgttcaaaagaacagaaagcataaagaataaagaaacaaagagagtctcagagaatgtggaacatcattaagcataccagcatacacatatgggagtaccagacaggcaggggagatacaaaggatcagaaaaaaatatttgaaggaataatggctgaaacctcccatatttgtggaaaacaataactgacatatccaggaagctcaatgaattccaatgaataaatgcaaagattgacaaatggaaacatcacagtaagatatctgaaagtcaaaaacaagaagaaagtcttgaaagcagtgtgagaaaaatgatttgttacttacaagggaaccccaggaagattaacagctgacttcagcagaagcaatggaggccagaagcaaaggcataacatattaaaaatgctcaaagaaaaaagaacctgtcacctaagaattctgtacctggcaaagctgtctttcaaaaatgaaggcaaaataaagacttcctcaattaaaaaaaaaaaagttggagaatctactgctctcaaaacccccttaaaagagttctctaaatacttaaagaagttattcaagctgaaagcaagtgagcctaggtagttattcaaatcaacaactacaaagcaaatgcttgtaaaggtaattatataaatataaaagacagtagaaatgtaatttttctctgaagtgattttaaaataaattctataaaataatatgtatataatgtattttggggtctataacatataaaagtgtaatatatttgccaaagaagataggtggatgcaaagcaatacaagactaaggaaatgactacagatggtagattaatatttattataatgtctttcttggcttatagcatcaataaatgtaatatgtataataataccacaaaagatggcaaaaagggaatagagctatataggtgtaacatttctgtataagactgaaattaagctagtgtaaattagaaacttatttgggtgagttaagatatatgcagtaaaccctagagcaaccactgaaaaaattcaaaacatatagtgaaaaaaattattaaggaagtttaaatgctacattataaaataattacttaatgaaaaagaagtaaagaggaatagaggaacaaaaacacatgagacacagaggagaagaagaatgacataataaactcaactaaataataaaattacatgtgaatacagtaaatatgtaaattaaaaggcagagattcccaggctggataaaatctccaggtttaatatccctttgccccaaataaactccagctttttttcctatgatgtatttgatcattgtgctggtttacaaaagatttctaacctttctaaaatctttaaaatcagcggcgaagtgttctatctcatttcacccatatatatcagagactcaaatcctgaaaaataccaagttgacctgcccattcttgagttctgctgaatggtgtgttcccagatcactatggatattgctgtttacttgaccaattacttttagtcaacaagatttgaacaatgcttttgattcacacagcgtgagacctagacttccctcatattgaaataggagcattagcatcctggattcctgcaccggcttttgaaccttatgtttcctgcaccccaagaagccatgttatctggacattgtcctctctgtgatgggaaagaagagttttttcaacaaatgttgctaggacaactggatatctagatacaaaagatactgcatttatgttaccagttttctgtgtcagtccattttgctctgatgtaacagaatactgcagactgggtatttgtaatgagtggaaacttattggctcacatttctggaggctggaaagatcaaggggctggcatatgataagggccttctcactctgtcatcctatggtagaagggcaaagagagggtatggatgggacaaatatcttcttttataggaacccacccctgaaataacagcattaatccattgatgagggcagagctctcacagcctaatcaccttttttttttttttttgagacggagtctcgctctttcgcccaggcgagagtgcagtggtgctatctcggctcactgcaggctccgcctcccgggttcacgccattctcctgcctcagcctcccgagtagctgggactataggcgcccgccacggcggccggctaattttttgtatttttagtagagacggggtttcaccgtgttagccaggatggtctcattctcctgacctcgcgatccgcccgccttggcctcccaaagccctgggatcacaggcgtgagccaccgcgcccggccgcctaatcaccttttaaatgttgctttattaaacactgttgcattgagggttacgtttccaagacaggcttttgaagtgaaatgaaaaatttgaccattcccaattatagtttgaaatttcaatgctcctttcttagtatgtgattgaacatggataagataatcagtaacggtggatgtaagaacactattaaccaacttgactccactgtcatatgtagaacacaacacccaacaatagcagaatgcacattatattcaagtgctcataaagcattattttgtatatatgtattttctcccttttttgataaagttagctagtagagtgcctatgtagttaatattttttaaaaaccacaggcttctcaattattaattacatctatggtttttaaaatattatcttcattaatttctgctttgatccttattcctttctttcttgtactttcttttatttttgttcttttttagtgttttaagatgaaaattgaattgtttcattcatctttttcattttttaaaataaaaacatttagtgcaatgaattttcctctagaactgcctttaaatgcatattacagattctcatatgttgtatattttaaaataatatgtaaatatatatttgcatagaaaaacatatttacatacaaaatatgtatttacatatttaaacatatgtattttctgtttatatttttccttttactcaggagttaataggatatttttaaaatttcttggtgaaagcgcctttatcttattgttagtaaagtctatgtttttgcattgtgatcagatagtgcagtttttaatatttcttgagttactaatttttctttccaacctaatatataatcagttttttgtgactatgccatgggcacttaagaacaacacagatcttctattatctgtcaagtttaatatgtagccataaaatctaccttatttttatgttgctatttttgcccacttgatctgtctttttctgataatggtgtattatagttttctattatgggatcatctatgtcttgtctccttacatctcatacatctcatgcagttttttattcataaaggtggttattatgttatttggtatataagtctccataagggtcaaatcttcatgtgtattatatcttttagcataaaaaaagtgtccttctttgccttgattaacatggtgggacttgaatacattgtgtgatataagaattactacgcttgcatgcgattggcatgaaaaaaaaaaagattactcctatctctttttgttttcatgtgcctgatatactttcgcccatccctttattttcagtcttttagaatccatttgttttagattcatctctcatagaaaacatattatgttttattttgtgagcccactgaaaatatttttcttctagtaggtgtgtggagtccactcacgtgtgtgtgtgtgtgtgtgtgtgtgtgtgtgtagctatgactgatatttattgtgtttgtattttctttatatttgctacgctcttttgtcacggtgtagtctttgcttgcctatttattcatacttaggagagtttttgtttttgttggagtgtttacttttgtacctctcttaattctgttagttctgtgttttcctagttaatcttttacttctgatttatcagtttgggggatgttcttcagcactcccctattctcatgcaaagtgctttcggttttcctctttttttttttttcctcctcctgtgtttagttgtcttatttctactttgtcacaatattagtgacatttgtatgctagtcttctaccctggatagggaatatacacctgtcagatggaaggaatatcatgttgtatgctgctgtcaaatagatcctaacatactttaataatcttttaaatgatataatccaagttcatagttaactcctgactttttatttctatcatattcagtagatatatcagcattgacagccatcccactgcaatatcacttcacattttgcttagaccaaagggttctgagaagcttctggagctgttgtgaaagccagtttcattaaagtcaagtcagacatccacctgtgctgttttctgctataagctgaatgcaggggatacaatgttaggagcatcagtgtggtatgaggaatgtttacttattggtagtagacttgtctggatcaaggataagtacaagtatctgagatgctgaggtgtggctgaatgaatggccatctgttctattgcaacaggataaataacacattcggagcaggcctaactggtgaactcctcaattatctcacaatagcactatcacgtgtctttcatttttcacagcacagtgtattttcataaaatctttattggtagaccacaactttagcatttcccattcaagatacaactactgtgtcacttggatagcttggtagagaggaaattggctattttcagagtaaagaattcaaggaggaaacagattataaatgaaatgacaaaggtgatgagatcaagcaatgctgacgtttgtagcaaggagtagagggctgagatgcctgtatgataagaaattataatggaaccaatcttgtgctttattttttattaatttggagcattctctgatctgatttattttctatgtgatattttgctgcaggttaaaagctgaaacaacttcaaggaaacttcagggaaaagaggtgagcagccactttggtacttttgaaattctttgttctgtgggcaatgatgtcagaatgtcaaagactgtgagttcattatttcagaggcttaaaggagattattcttttggtagatatatttccccatgggtgtccctaccttgttcaaggattccttattattgtttcttctctttgtttaaatctctttttgagatgacctaaacaactgtggagaatcattgatatatttccttttttcactgttcatgttgggtgaaaataatcttgtagtgaaattcacatgttctaaatattgtttttttacatctttatctggcacattcataacatagatgtttctatacatattagtactgtaatcataccatatattattctgttaccccacttactccttaaacttttagttaattaaagagtttttataaagtcccccaatagattttttttttttgagacatagtctcactctgttgcccaggctggagtgcagtggcgtgattttggctcactgcaacctccccatcctgggttcaagcaattctcctgcctcagcctgccaagtagctgggattacaggtgcctgccaccacgcccgactaatttttgtattttcagtagtgacagggtttcaccatcttggccaggctggtcttgaactcctgacctcgtgatccacccgccttggcctctcagagtgctaggattacaggcttgagccactgcacccggccagattttaatctaattttattagaacaattcagtcatatgttttttcatgctatgtatatgagagttccattattcagatactaaacaaatgtctactgtacatttactgttctcactgatgatgcattagataaccatgcacaaaataagcctggctgtggaaacgcttatttgttgggagggtgcttgtttggatcgatgatgagaataattgtctgaggatgctgagggactcattccagatgtcaatctgaggtccagatgtgcggccctccaataggacaaataagactctcagagcctggctctatttggggatccctcagtgacaacatagtacccctgtgagcgtgccttttctatctcttcgaagagggcagtggcatcctgtcttatgagtcagtgtgcactttagtgtgcctagtgacccaagacttgctttaattgtagatagatacttacatataggaaatatttcttaagtaacaaatgaaaaactttagaagattgaattaagggtcaagcaactgtgatatgtctgaaaatctcattagtgttgtgctgaaagaaggaaatatggcatgcctctattaaataatgacagtggaaccaagtttattgctttgttatttttactgtggagtattttctaagattatttttgctttttttttctttcatgttttgctgagatagaaggcctggaatctgatcctccacttcagagaacaggggtgagtagctaagccattatcttttgaaattcatatgtcatgtgctctttgctaggtctttaggtcgttttgtacatcttttcagaagcttattggaggacattttcatgatatgtccttttcctcattgagaccctcaccatgtcacctacactattgaatccttatcatttctcttttaattttaactctcttttgcttttatggaaaaatgtagaatttaagagaatttttggcaatttcatattggatcaaaatgtattgtagtgaaatccaggtgtgccaaaatattaacagattttccccatctgtttaattattggggtttcagaatagagactccatggttcataatatctttgtggtcatactacattatatttctgcttctaatttaattattaaatattgacttgaattagtcttttcctcattgttgcaacaaggtaagttatataggaaattttcttctcttgatggcatgtctgagataatcatagatataagacacctggctggtttctagaatgcatgtaatttttatttcttgatctgtgtgttgagtacttgctgtgattgcatcatgcaaatacattgagctttacaattttagtgtatgcacttttctacatgtatattattcttcgatagaaagtaaaaaaaacttatcgaactagtcaaaatattggttaatacataaaaaaagtctcaagtagattgtgtattacatggtgcttgttgattgatgccctcataatagatcaagtgggttctctctttagcacagggctttttagcaaatcatgtcatgagtagttactcaagtatttttattttaacacatttatattttttctatgtatattcttaaattctcttatacttttttctctgttataaaaacatgctgaacaatctcaagtcttaaggattgcagtattgtccccacatattcatgtattttggtactcaattctttatactttctttgacagatcacttgaactggcacatgtctcttgttttgcagagagggaattaatgtgataccttcatgcttttctattctatgtgctacataattgaatatacaagcaaatatagttgttaagatttagtgtgattatttctacaccacatgcaaagaagtttctcatagatcttaatagaggcccacatgcattgtacagtttagaatttggggaaatattgatgaagttgggtaaagtataaagccaaaagtcagaacagtgaactccttgcttaaggatttccttggagattacttagtcaatacacaactgataaatttaagtgcttttcaccttttgagttctcgacatactaaagctaaaatgtgtttcaacttttaatcctgcttccctgattttcccttttttagtctgagatcaaagagtttcagccataaattactgccaagagtaatcacttcattttaagaaagcttaacaatatagaagaatataaaattatttatgacagatgtatttttaaccttttccccatgctttccagaggaaatatgtttaatcatctgccctatattagggaaaaactttctatgctaatacaagtatctatcaatccatttatctttctatataagatgtattgatcataaccaattaactttactgtaaatgagctttagatttgacattttggtagtaatatatgttgtacaatctcctgaggtcctataggtcttgaggtctctatgtcaaaaactatagatgtgccagtgtcctcagtgaatgtgaaggacaccacattttccttagccatttcttgttttcagaataatggttatcaacattttgctactgcaagataccatacatttataatcggaatatgccagtttttatgcactcatgcctctgtttctgtagagcattcccagaatgagtaatgcttgaaaattaggtccatgtgatttctttaatgagttatagtcaaatcatgaaatattcaggttaccattatttcagtaatgtattagaatgtcaaggtaaagttatctacattgtatatatacacacaacatagatataatttatacaacatctatatttatacaacagatatatatttatgtatatatttatacaacataaaatatattttattatttaaacataaaatatattttattatttaatatagattcttaagtgataaatatgtttaatattattaaaataggttaaaataggttatagttagtacagtgaaaattggcagcccttttacaaaacatatgccataactatagcatttatcactgacagtcataccaggatagtcttttatttccaatcacttaaatattcctaattgcaaaagaaatttgaagactaaaattcagaagttttgaaagagccattgcctgggtaaactatacaggtttcagttttatttataataattatgaggccaggcgcagtggctcacacctgtaatcccaacactttgggaggccgaggcgggtggatcacgaggtcaggagatcgagaccatcctggctaacacggtgaaaccccatctctactaaaaatacaaaaaattagccgggcgtggtggcgggcgcctgtagtcccagctactcgggaggctgaggcaggagaatggcgtgaacctggtaggcggagcttgcagtgagccgagatcgcgccactgccctccagcctgggagacagtgcgagactccgtctcaaaaaaaaaaattatgtatatatttataaattaatacttaataaattaataacttgtgataggcaatgcaaagatgacagtaaaaggacaaaattgattagattgataaagtcctgttaacatgaagaaattgaccaggataccatccacactataaagttagagaaatttatcaggacaattccctaaaatactcttctcaattttaacattgtaacaggaatttttaaaattttggtattatgtgtgtttccttccagataatttgaacagattcatatttggtatttttaaaagccatatctttgtccttagtgctggcaatgtattcttgagaatgaacaaataagagatacgtaaaagcataagagaaggtatcaggttgaagtagtcaatcagttatacagaacacaaagaattttatcttgtataatgtttatatagctttatagaagtgtgctgaaagggctataaaacatggacattattatctcattgaaaggtccaatacgtactgaaatacatgcttttattttgaaccaaccaccctataaacgttgtatggcttatttagatgagagcccaggttgtgtgtgtctgtgtgtgtgtgtgtgtgtgtgtgtgtgtgtgtgtgtgtgtgtgtacctgacagggaagcaagaacatcgagttgccaatgcactctgtctatggttagaatcatgctgaaaacatggctcccccagttctggaatgagcccacagatcaagcattccccaaagacatagcaggctcaaatccctgtgtacacaatattttatgattatcttatgtcagtactttcaaagtatacagtttgtgtgaagacaaatccaatgtcatttttcttggctagcctatatgtgtggtaaatccattatttacttacttgcttcctgaaaattacaattagattaacaaactgcagcaaagtgggcatgatgagatagagattgaagtgtaagcttatgttaatgatgcccttggtttggataaacacatctaagagaaaaatggaaaaacacacatggcagggaagccttgatagagccaaaatataggattgtatgtagtaatgcaatccatagatgagcatttggcagtaatattatttttcagatatggataaaaattgcttaggagagtaaagagagacaaagttgaaagcaggtttatagtaggtgttgttttagtgttgatccctttttgctccaataatcaaagtgataaatattgaaaattgattcatgcagcattacttactccattctaatttttatatatgtcaaaagtgccatctcccaaactgtgctatccccttcaggagaagagactctgctgaagtttataaggttgacatattgccagcttcaataatgtaaagatgaagtgtatactgaattcttaatgcaaataacaactctattggaaagtaacccagttatagaagtgctaatttgtcaggagctgccttaccaagatcatgatgagtacagttatctcaggattctgaaagattgttttccgatttcaactagtctagctgaatgttccttgatagaaagagaggacttttagaattggttcaatatgatgacctcctgaattatctcacatagcccgtttgtacatgcctttcttttctctcagaaaatggcactatcataatagctttcttacacagacttcaccttagggttttacattaagggaggggtctggtgtttcatttattttgaagtatttgttgttgattgtgtacagtgcttgagtaaaaaattgaatatagaaacatctagaatatttttttaaaggatcagtgtttataaagtgaattattagtgtcaataatgttgggaaagttttaagagaatataggaaacttgaacattacacaactacaatgggaccaaattgtggggtctcattatagttaatatttatgtatttttttccaattgatttgtgtgctttttttctgcatgtttttggcagatagaatggctataacaagtaacagcatgtcaggtaataaaaataagcagagccctattcctttaaaaatcttcactgatgggagggccataaaataagtcttaatacatttaaagaattaaattcatgtaaaccatgttaatttaattccacaatgatattgaattagaaataagaggaatatctcttgaacatctcctaaatgtttggaaatttaaattagcatttctgacctatttattggttaaaaaagatacaaagaaaggaaaattgaaaagtcttttgaactgaataaaaataaaaatatagaatctaaaactttatgggatactgacaaaacaggatatagggaataatttatagcactgaaatgcctatattagaaaagaaaaaaggttttaaatcagtaaatttgtattttaccttaagaaacttagaaaagaacaaattaacccagacttaagtaaaataaaggcactaataaagataagagcagaaatcaatgaaatataaaacaacaaaacacagagaaaaattgagaaaatttaaaaatagcctagtgagaagatattgataaacttgtaaccagaccaatttaagaaaaaaagtcaaaacacaaataccaatatttgaaaatgtaggagggcaaatcattacagattctatgaatactaaaatgataataaggaaaaattatttaaaaggggcatgtcagccaggcatggtggcttacccctgtaatcccagcactttggcaggccgaggtgggaggattgctagagctcaggcattcgagaccagcctgggcaacatgttgaaaccttgtctacacaaaaagtacaaaaattagctgggtgtggtgttgcacacttgtagtcccagtcacttgggaggctgaggcgagaggatcacttgagcccaggaggttgaggctgcagtgagccatgtttgtaccactgccctccagcctgggtgacaaagtaagaccctatgtaaaaaaaaaaaaatgtatgccaacatttttcaataacttaaatgaaatggaaaaattccttgaaagacacgaactacaaaaactcagtgaacaagtaaataacctgaatagccctgtatcaagtaaattgaatttgtagttaaaagccttccaacagagaaaacttcaggtacctatagcttcatatgaaatgaaaaaaaaaataccaatcctctacaagattccagaacatttaaaagaagggaatatttcccaacttattccatttggacagcaatacccaggtaagaaaaagagacacagaaatttaaaaagaagaatatacattattccttaggaacataaatgcaaagaaatctaatcaaaattttggcaaatgaaatgtagaaatactttatgaccaagtgagagttacccaaagaatttaaggttggttttatatgtaaagatcaaccaatataggaaaatcacttctggaaagtcagagtaagaaactccaaaaatctactcctccataaaaccaataacagccttgatagaaatagttgaaattaattttccaaaactttggaaattaaccaaaggcttacaaaattccagagaacattaattcaagaaaaatggctgaatcagtaagaacagccagctttgtggcattttaatatgaccccttcccatgcttttctccctagtgctgagatagtcttaaaaattagcaggatagcaaccactggagaagaaaggtttggaaatttcccaaaaagttccatccccatagaattatcactatttgacctctaaagcccaatctataggatttatattcatttggactgactcagagctcactcagtaaggaaatctcaatttcaaggtattggtcaaaaagaatccatggcaattgttgactatcacaactgcctgaagtcttggtaacagttgggataaacaagaagctgatcaaaaactgaaaactaaaatcttgggaatgagatatctacaggatgcttcaaaaagctttgatacattcctgtttatctagaaagctacatgcaggctgggtgcagtggctcacacctgtaatcccagcactttgggaggccgaggcgtgcggatcatgaggtcaggagtttgaggccagcctgaccaacatggtctctactaaaaacacaaaaattagccaggcgtggtggcgtgcatctgtaatcctagctactcaggaggctgagacaggagaatcgcttgaacccgggaggcggaggttgcagtgagccaagattgtgccactgcactccagcctgggcgacagagcaaggctctgtctcaaaaaaaaaaaaaaaaaaagccacatgcatgtaattgtttacctctggctttccttttatgctctgggcaagctaaggaagagttgtgaactacctaagtgctgaatgggaaccataacacacacacacacacacacacacacacacacagcaccttagtaaagggtgagaggcatgttagttagaagcattaaaggaaatctctttctagtcattatctgtgcactaacctaactgagcagagacttcagtatccacatactacagggcatataaactttacagaattagtccaggaaaatcatatctaaaaaaaaaaaaaagcagtaacaaaaataaactctgggaaaggggagaatatgatttaaagagttgccacattatacataatatgtctagtgttcaacaaaaaattacgagacatgcaaagaaatagaaaaatatggcacaaagaggataagatgaagtcagtgaaactatcctcgaggaagaccagatgttggtcttactagacacagacattgaaccagctattaaaaatacgtacacagaactaagaaaaacatgtcaaaagggttaaagaaaggtataaaaatagtgtcttaccaaatatagactaccaataaagagatagaaattataagaaaagacaacatgaaaaaatataaagcaaaaaaattagacaattgaaacaagagggcctctattcgcagatttgagcaggcagaagaaagaatcagtgaacttgaagatatgtcaactgagattatccagtctgagcaacaaaggtgggaaaaaatgaagaaaactgagcaacaaagaactgtagaacagcatctctcataccaatggatacataaactggagccctagaaggatgaaaaaaggagaaggaaagaaaacttcccaaattttaagaaaaacattaatttatatacccgagatgaccaataaaatccaattaagataatctcaaagagaccaacacctatacacatcatagtcagcgtgtcaaaagacaaacataaggagagaattcttgaagatagtaagaaaaaaattattcataacatacacaccatcctcaataagtctgacaattgacttctcactgtaaaccatgcaggctaaaaaggcaatgtacataaccaaagtgatgaaataaaaaccttcaaccaatcattctagatccaacaaaactattgttcaaaaagaagaaatgaagacattcctaaacaaaatctcagagaaatgttctctataagacttgtcctaatagaaatgctaaaggaactccttcggtctgaaatagaaaggcactggagagtaaatcaaatccacgagaagaaataaagagaaccagtataagtaactacatgtgtaagtttaaaacaaagtataaatttattttgtttgtaacatttgtcttttcctatttgatttaaaatataatctcaattataaacttgtgttgatggtattatataaagatgtaattttgggttatagcaccaaaatggcagaataggaattttctgtaggtgtttcccacataagtatcaattttgacaaccatccatgggcaagagtaccttgtgggagttcaggagttgacagtaaaacttcagcacaccagaggagtaaagaaatctaagaatagattcattggaaagggtataaacagtttcactttacctgcatcaccaacccccaaaagtggcacagctcagtaacaagagcccattatttcttccacagaggaaaaggagagtataataagtaagtgtccagtttctcaagacatacaggcccctgcccaagagatccactttattttcatctcacccagaatattgaggtgatcagcaaggtggagtggttgggagagggtaaaagcaggaaagagagatggggactcaaacagcagcccatacttggaactgccatagatcctaccagttacttcatggactccatcaggaacccacctataagccacaggggatgcatccctcccatcttgccaacaaaaccccgaatgctccaaatgcctcacccactctttggctggctcccaagtgcgctcctgtgaaaagcgagtgagtatctctgcagatggcttgcaagcacatgttgacagctggctccactctgtagaactggaaaaaagctcacatacatgagaatttcaggacactaccctaaaaaaaaaaatgagacttcagcacctggcctggctttatgcaacctagagaaggtgatatgatttggctctgtgtccccacgtaaatctcatgtcaaattgtaatccccacgtgttggacaagggacttggtgggaggtgattgaatcatgcgggtggacttccctcttgctgttcttgtgatagagttgttatgagatccagttatttgaaagtatgtagcatgtcccccttcactctcttgcactcctgctccaccttggtaagacttgcttgctacccctttgccttctgccatgattgtaagtttcctgaggcctcccagctatgcttcctgtatggcctgcagaactgaactgtgagccaattaaacctcttttcttcataaattatccagtcttaggtagttctttatagcagtgtgagaatggactaatgcagaaggcatacaacctttagaatttgcccccttgagggaacaagatgtgtgaagcaggttcatccatagaaaatgtctgagagaacctcaaaatccctaacctgactaactgatgaaagtgtttctctcctaaggccagtcagtaaagaccagagggggtgactgtttctttaaatgcaaaggcagcagcacaataattcaagaaacatgaaaaatcaagaaaacatgacaccaccagaagaacacaatcattttccaataaccaactccccaaaaatggagatttacaaattggtttataatgaattcagaacaattatgttaaggaagctcagcaaactaaaaggaacaccaatagactactctgtgaagtcaggcaaacaattcatgaacaaaactagaaattcaaaaaagagaaaaattatcttaaaagaaaacccagaagttatggagctaaagaatacaatgcatgaaatgaaggagcgtatcaacagcaaagttgatcaagcataagaaaaaaaaaatctgtgaaactgaagactggctatttgaaattattcatcagaggattaaaaaaaaaagaatgaaaagaaataaagaaagcctacaggatgtataaaacaccatcaagagaactaatataaggattattggagtcataaaggagaagagagaaaagggtagaaaacttatttaagaaataatggctgaaaactctccaaatctaggaaaagatatgagcatccaggtatatgaagctcaaagatccccgtacaggatacattccaaaaagacttcaccaaaacacatgataatcaaactgtcaaaagcaaaatcaagacgatgaataaaccaccaatcactaagagggagacaggattcttatgttgtcattattatttacatataatttcagtaaatgttattggaaaatttataatgttttaaaaaaagaaatttgaaagcaccgaaagaaaagagactcatcacatacagggaacccttttaaggcattcaagagatttctcagtagaaaccttacaaaataggagagagtgggatgaactatacaagtgctgcaaggaaaaaaatgccaaccaacgctttacctggcaaatctgttcctcagaaatgaaggagagagaagaactttcctagacaaacaaaagctgaggcagttcatcaccactagacctgccttacaagacatactaaggggagttcttcaagctgaaatgatatggcaatagttagtaatatgaaatgataaacctcactggtaaaggaaagtacatagtcaaatttagaacactttgatactataatgatggtgtataaataattttactgtgctatgaaggttaaaagacaaaagtattaaaaaaaacccatagctgcaatagcttgtcaatgcatactacagtataaaaagatgtaaattagaacattaaaaacatagcatgcaagggtagggaagtaaaagtgtagttttcatatgtaatcaaatttaatttgttatcagcttaaaataaattgttatacctatgttttatgtaagtgtcatggtaactataaaggaaaaacctctagtagatacacaaaagaaaaagagaaaggaatcaaaacataacactacagaaaattatcaaattacaaaggaagacagcaagggaggaacaaagtaaaaagagcaagaaaaaatttaacataatgaaaacagtaagtccttacgtgtcaataattactttaaatgtaaatggattaaattatccaaacaaaaaaacagactggacaaatggattttagaaacaacaacaacaacaaacaccgcacacacacacacacacacacaaaccacccagccccaactatgtgctgcctacaagagatttacttccactttaaggacacatacaggctgaaattaaaagaacagaaaaagatattgcatgcagatagaaaccagaagagaggagaggcatctatacttacagcatacagaaaagattttaagttaaaaactatatcaaaaggctaagaaggtcaaaatggtgaagcagttaattgttcaagaagacataaaaattgtaaatatttatacacccaatattgaagcacctaaatatataaggcaaatattaatacatataaaaggagaaatatacagcaatacagtaatagtagtgaacttcagtgcctccctttcaaaaatggataatccagacataaaatcaataaggaaacatttaacttaaacttcactttagaccaaatggatctaacagacattatactgaacatttcatccaacagtggtagaattcacattcttctcaagcacacatggaacattctccaggatagattatatgttagctcacaaaataatattacaaaatttaataaagctgaaatatcaattattttgcaccacaatagtataacactagaaatcaataacaagatggaaactggaaatttacaaatatatagcattaacatattcctgaacaaccaatgggtcaaagaaaaaaatcaaaataattttgtgacagcaaagtagaaacacaacataccaaaacatacaggacacagcaaaagcagttctatgaggtaagcttatattgataaacacatttaaaaaaagattttaaataaacaacattacacctcaaggaactacaaggaagaaaaaaaaacaagccccatgttatcaaagggaaggaactaacaaagatcagacagaaataaatgaaacatagactagaaaaacaatagagactattaataaaacttagagttagttttttaaaaaataaaatcaacaaacctttagctagactaaaaaaagagaagactcaaataaaataaaaaatgaaagaggagacattacaactgataccacagacatacaaattaagagaaaactatatgccaacatattagttaacttgcaatgggtaaatccctagaaacatacaacctacaaaaactgaatcatgaagaaatggaagatctgaacagatcaataatgaataagggaattgaatcaatattcaaaaatctcacaaaaagaaaagctcaggatcagatggcttcactggtgaagactgccaaccatttaaaaaaattaataccactctttattaagctcttccaaaaaaattgaagaggagaaaacactttcaaattcattataagaggccagttttaccttgatatcaaagatttaaaaagaacactttgagaaaggaaaattacaggccaaaacccttgataaatatagatgcaaaaatgctcagcaaaatactagcaaacctaattcagcaacacattataatggcatacatcatgaccaagtgagattcatgcctcggatgcaggatagttcaatataatcaaatcaacaaatgttacactactttaacagaatgaaggataaaaatcatatgatcatctcgatggttgaactagtttacagtcccaccaacagtgtaaaaatgttcctatttctccacatcctctgcagcacctgttgtttcctaactttttacagatcaccattctaactggtgtgagatggtatcttattgtggttttgatttgcatttctctgatggccagtgatggtgagcatttttcaagtgtctgttggctgcataaatgtcttcttttgagacgtgtctgttcatatccttcacctactttttgatggggttgtttgtttttttcttgtaaatttgtttgagttctttgtagattctggatattagccctttgtcagatgagtagattgcaaaaattttctcccattctgtaggttgtctgttcactctgatggtagtttcttttgctgtgcagaagctctttagtttaattagaccccatttgtcaattttgtcttttgttgccattgcttttggtgttttagacatgaagacagtgtggtgattcctcaaggatctagaactagaaataccatttgacccagccatcctgttactgggtatatacccagaggattataaatcacgctgctataagccataaaaaatgatgagttcatgtcctttgtagggacatggatgaagctggaaaccatcattctcagcaaactatcacaaggacaaaaaaccaaacaccgcatgttctcactcataggtgggaattgaacaatgagaacacatggacccaggaaggggaacatcacacactggggatggttgtggggtggggggaggggagagggatagcattaggagatatacctaatgctaaatgacgagttaatgggtgcagcacaccaacacggcacatgtgcacatatgtaacaaacctgcacgttgtgcacatgtaccctaaaacttaaagtataattaaaaaaaataatgctgctataaagacacgtgcacacgtatgttcattgcggcactattcacaatagcaaagacttggaaccaacccaaatgtccatcaatgatagactggattaagaaaatgtggcacatatacaccatggaatactatgcagccataaaaaagatgagttcatgtcctttgtagggacatggatgaagctggaaaccatcattctcagcaaactatcacaaggacaaaaaaccaaacactgcatgttctcactcataggtgggaattgaacaatgagaacacttggacacaggaaggggaacatcacacactggggcctgtcgtggggtcagggtagggggagggatagcattaggagatatacctaatgtaaatgacgagttaatgggtgcagcacaccaacacagcacatgtgtgcacatgtaccctagaacttaaagtataataaaaaataaatcatatcatcatctcagtagatttagaaaagcatttaacaatattcaacatcctttcagaactaaaaactctcaataaatcaggtatagaaagaatgtgcctcaacactataaaagccacatatgacaaacctggaggtaatatactcaatggtgaaaagtaaaaagctttgactctaagatcagaaccaaaacaaggatgtccattctcaccacttatatttaacatagtagttgaaattctagctagagcaattaggcaagaaaaaaggcacccaagttggaaagaatgaagttaaattgtctctgtagatgacatgatcttatatatagaaaacactaaagactccaccaaaatgctgttttaattagagcttaaaaaaataattcactaaagttgcaggatacaaaatcagtatacaaaaatcagttgcatttctaaacaccaaaaacaagttatccaaaaaattaagaaaacaatcctatttgtgatatcatcaaaaaataaaatactaaagaataccaaagaaactgaaaataaatggaaataaatggaaagatagcccatgttcatggattagatgaattaatactgttaaaatgttcatactacccaaagcaacctacagattaagtgcaattcctactaaaattccaatgacatttttcacagaaatagaaaacacactcctaaagtttgcatggaaccgcaaaagactcaaatagatgaagcaattttgagcaagaacagtaaagctggagacatcacactacctaacttcaaaattttattaatcaaaacagcatgacataaaaacagacagaaaagaccaatggaacagaatagagagcccagaaataaactcacgtttatagagtcaactaatattcaacgaaggtgccaagagtacacaatggggaaagtatagtctctacaataaacagcactgggaagacaatatccaaatgcaaaagaatgaaattacacccttatcttataccatacacacaaatcaaatcaaaattgataaagacttaaatataagacctgaaaccatacaatctttaggcaaaaactcattgacattggtcttggcaatgatttttttgatatgacaccagaagcacaggcaacaaaagcaaacctaaacaagtgggaccctaacaaactaaaaagtttctgcacagcaaaggaaacaatcaatcatcagaattaaaaggcaatttatgaaatgggagaaaatgtttgcaaaccacatatctgataaagggttaatatccaaaaatatataaggaatgcataaaattcaatagaaataaacaaacaaataatccaattttaaaatgggtgaagaacctgaatagacattttttcaaagaagacttacagataggcaacaggcatatgaaaaaatgcttgacatcactaataatcagggaaatgcaaatcaaagctccagtgaaataccacctccaactattaggatggctattatcaaaaactcaaaagaaaacaagctgggggaatgtagagaaaagggaaaagaagatccttatacactgttggtgtgaatttaaactggaatagcccttatggaaaacagcatggaggttcctcaaaaaattaaaaatagaactactatatgatccagcaatttcactattgagtatatatccaaatgaattaaaatcactgtcttgaagaggtatttgcacactcatatttatttcagcattattcacaatagccaagacatggaatcaacctaagtgttcatcagtagatgattagataaagagaacgtggtatatagacacagtggaatctatttagtgttcaaaaagaaggaaatccaacttttaaaatcctttaaaaagttaaactcataaaaacagagaggagaatggcggtttccaggaactggagggtgggagaatggggagatgttggtcaaaaggtacaaactttcagttataaaatgaataagttctagagatctagtgtacaacagcattactatagttaataataatattttttatacttgaaatttgctaagagtaaatatcaatattctcaatacacacaaaacagaactatctgaaggcactgatatgttaattatcttcattatagtaatcatttcacaatgtataatgaatatcaaaacaatagtgtacatcttaaatatatacagttttgatttgttaatcatacatcaatgaagctagaaaaaatgttgtaatttttaaaacaatagtaatataaattaggggtgaaggaattgacctatgttggagaaaagtttttgtaaactatttaaattaattggtatccattcaagctagattatttttaattgttaatttaattgtaatactaaggcaaccactaaaaaagcctttaaaaaaatatagcacttgaggctgggcatggtggccctcaattatatatataatatatataaaatatatattatatatatagtagatgaacaacaatgggatttaaatggtacactagaaaatatctgtttaacaaaaagaaagcaatagtggagaaatataagaacaaaaccatgtaagatttatagaaaatgaatagcaaattggttgacctaaaccctatcttataattatattaaagataaatgaaataaatactacatcaaaaggcagagattatcagaatagagaagaaaaatccaaaccataattcaaccttatgttatctgtatttagaatatttagagtcaagacacaaatagatagagttccatttgggcgtgaaaatatttaccatgcaaaatgtaattaaaatagagctagagcagcaatactaatatctgacaaaatatactttaacaaaaattgttgctaaagacaaaaaagaacattttataataagacacaacaattataaacatatacaccaaacaatagagcccaaaatatacaaagcaaaaactgctagaattgaagaaagatagaaaaatcaatgattacagttggaggtgtcaataccaaactttcagtaatacacagaacaacaagtcaaaagcaaaaaggaaataaaaaactacacattatcatacaacaccttaatacgatatccaacaatagcagaatacacattattctgaagtgcacatggaatattcttcaggatgacacatattaggctgtaaaacatatcttaataatttaaaagaattgaaataatacagcacatattctctgactgcaaaatattaaaccaattacagaagaaaatgtgggaaattcacaatgatatggagatttaaaaatacttcaaagtaaccaatgaatcaaagaacaaatcacaagagaaattagaaaatattttagatgaataaaactgaagaaacaacataccaaaattttgtggttgtagctaaagcagtgcttcaagggaaatgtataacagtatatccctaaattttaaaaaaatctcaatccaataacctaatttttcaccttaagaaatgagagtgaaagagcagacttaacccaaagtaaacagaaggaagaaataataaagattagcatggagataagtagtgaaaataaaaacaatagagaaaattaataaacttgaaagttggttcttctgatatatcagtaaaattgacgtattattagtttgaccgagaaagaacaaaagagagaagattcaagttactagacataaatgaaagtatagatatcaccttacagaaattaaaagaattctaacagaatattgtgaaaaagtgaatgtcaaaaaattaaattatatgagatacacaaatccctctaaaggcacaaactaccacagctggtgtaaaaacatgaatacaccatttacagttaaaaagactgaatagataaaaattttaagaagaaattgagtaagtaatttaattttcaaactataatcccaagaccagatgttttcattggtgaattctaccaaactttaaaaggattaatatctatttttcatacactctttccagaaaatagaaaaggagggaacactctataactcactgtatgaggtccgtattacccttatatcaagaccaaacatcataagaaaagaagactaaagacttatggtttctgctctgatatgtttggaagtcatcactactattgtcacaaggaaaaatctgaacaaactaaagtcaacgatttcttaaactaaccatagaattgaggtaacgggcgaaaactggagatgtaggcaaatacaaaaaaaatcacagtttatcaggagcagaaactgctgaaaccagcaactcgtatgaacatgttaagtggtaattgacaaatttctggagattgaatgtggactggattgagagttaggaactcctaagtgcccagtttttgatgaccccacacacttttgtaaactagacttccaagagccccagcaagtttcttacagtgaagactgcagaaaaatcccctgatgcttcagataggaggaagggaaaagcaactattttgaaataagcccaggggacaagtagttatttctaaacactctcagagcattttctttcacacggcagggggctccctgcaagggaagctactttgcctgagccttgtctgatgtaggagaaaaggaattggatggctcaagctccatctagcctttctgatttatataagggaagcaaaaaataggttaagaaactcttctgaaagtcacaactcagatttattttatatttatttatttatttatattttttgagacggagtctcgctctgttgcccaggctggagtgcagtggcgcgatctcggctcactgcaagctccacctcccgggttcacgccattcttctgcctcagcctcctgagtagctgggactacaggcgcccagctaattttttgtatttttagtagagacggggtttcaccacgttagccaggatggtctcgatctcctgacctcgtgatccacctgcctctgcctcccaaagtgctgggattacaggcgtgagccaccgcacctggcctcacaactcagatttaaccataagattatagaacacttctcctcccaaaacagagatatagatcaatggaacagaacagagccctcagaaataacgccgcatatctacaactatctgatctttgacaaacccgagaaaaacaagcaatggggaaaggattccctatttaataaatggtgctgggaaaactggctagccatatgtaaaaagctgaaactggatcccttccttacaccttacacaaaaattaattcaagatggattaaagacttaaacgttaggcctaaaaccataaaaaccctagaagaaaacctaggcattaccattcaggacataggcatgggcaaggacttcatgtctaaaacaccaaaagcaatggcaacaaaagacaaaattgacaaacgggatctcattaaactaaagagcttctgcacagcaaaagaaactaccatcagagtgaacaggcaacctacaaaattttcacaacctactcatctgacaaagggctaatatccagaatctacaatgaactcagacaaatttacaagaaaaaaacaaacaacctcatcaaaaagtgggcaaaggatataagcagacacttctcaaaagaagacatttatgcagccaacagacacatgaaaaaatgctcatcatcactggccgtcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattgctatatatatatatatatacccaaaggactataaatcatgctgctataaagacatatgcacaggtatgtttattgcagcactattcacaatagcaaagacttggaaccaacccaaatgtccaacaatgatagactggattaagaaaatgtggcacatatacaccatggaatactatgcagccataaaaaagatgagttcatgtcttttgtagggacatggatgaaattggaaatcatcattctcagtaaactatcgcaaggacaaaaaaccaaacactgcatgttctcactcatagatgggaattgaacaatgagaacacatggacacaggaaggggaacatcacactctggggactgttgtggggtcgggggaggggggagggatagcattaggagatatacctaatggtaaatgacgagttaatgggtgtagcacaccagcatggcacatgtatacatatgtaacaaacctgcacattgtgcacatgtaccctaaaacttaaagtataataataataaaaaaaggctacctaaaaaaaaaaaaaagaacacttctcctcccaacaccatatcaccacatcaaccaggactccagtgtaatagcagtgaattctaactgaaagaggtgaaagacactgattgtatttaagaaagatcttctaaggaaatccaaaaatagtaggggagatcaaaacaaagatactagaggaaattgaatatgtgacacctatagctacaaaaaaattaaacataacatagccctaaccatataaacataaaacctcacacaaagacctattatctgagattctgttgcctgatacattgcgttttatttcaataaaaaaattagagggtatgttaaaaagcaggaaaagttagtctaaagagacaaattgagcctcagaagtaggctcagatatggcagagatttggcaattatacctagagtttaatataaatgattaatataataagtgttctaacagaaaaaggcaacatgcaagaacggatgggtaatgtgatcagcaagaaggaaactctaagaaagaagtcaaaaggaaatgctaggaataaaaacctacaagaaataaagaatgcctgtgatgggttcctcagtagactggacaaggtcaaagaatcagtggatttgaaaatatgtcaacaaaaactgccccactgaaatacaaaagaaaaatagaattttaaaaacgtaacacaatctccaaaacagtgggacaattacaaaagatgtaatgtgcctaatgcaaatgacagtaggagtataaagggagaaaggaatagaaaatctgaagtaataatggcagagagttttccaaaattaatgctaaaccacagatacagcaagcccagagaacaacaaggaggaaatttagtaaagcgtctgcaaccaagtatgtcatattcagactgacaaaaccaaaggtgaagagaaaatattgaaagaagacaaagaggaaaataaatatcaagaaaatacatacgaaatacatcatacatacataagaaatacatcagaccatacaagcaagaagagaatggagtgaaatgtttaaaatgttgaaaaaaaaactatcaatttgcaattctgtatccagtgagattatctttcaaaagtgaagagggaaatggcagagaagtcatctccaagacctatggtttcccttcacagaaacactgaaaaatatgaacaaaagtggtcagaattaactttctaagaattctataaaatggtaaaatgtttacaccagtaaagcaaatgctgaattgagaaggcaacttaaaaaggtgaagaaaacttcgtattatttttatgtgtccttgccccacgtccttccctaccttagtcttgaagatggcagcccacatttctactgtggggctctggtttctgtttcctggttcaagagggagaataacagaccttacttttagtcattattatttccttctttctgatttccttgggtttattttgctcttctttctactttattgaaatgagaactaagattatgatttgagacatttttctaatgtaagcatttagtgctataaatttccatctcaacactgctttagtcacatcccacaaatttttatatgttgtaatttcactttcatttagttctatttttaaattttttctttttatacttcctctgactcacagattacttagaattgtgttgttcagttttcaaggatattgtagattttcctgtttctctgttgtctaatagttctgttccattttgtacagatagctcacgctgtatgatttcaattttttaaaaaattgtgctttgttttatggcccagatatggtctgtgctgtgaatattccatgttattataaagtatgcctgttatattattatatatatataatatatataattataaagcatgcccgttttgtattgttagcagagtattctagaaatgtcaatgagatcttgttggttgatggtgcttttcagttctatatctttgctaattttttttttttttgcttagtagctatatgagattctgagagaggaaattgaagtctccaaccataattgtggatttgtctatttctcctatcagttctatcagtttgtgcatcacatatttgaggctctgttgtttggtgcatacacaagtggaatcattgtgccctcttggtggcttattttatgattatatagtgcctatctttgtggtatttttatttgctcttaaatctactttgtgttatattcatatacccattcttttttaaaaaaaattgtttgcgtgatacatcttttccattcttttaatctcagcctatctgtgccattgaatttgaagtgagttttcatatagagaacatattattgaatcatcattttaaaaattccttttgccaatcttttttatactgaggtaaaattgacataaaatttatcattttaaagtgtacaatacagtggcatttggtaatacacatgttatgcaacgttaactctacctggctcctaaatgttttcatcatccccaaaaggaaacttcatactcattaagcagttaattcccattccttctctcggccactggcatccgcaaacctacttttctgtctctatgaatttacctattatggatattttgtataaattgaattatacaataagtgacctttatgtttggcttcgttcgcttcgcatactatttttcgatattcaaccatgttgtagtatgtatcagttttatttgaataactcaattctttttgttgtatagctaaaagttgattcctaggtcataatgataattctatgtttagtttattgaatagctgccaaagtttttccacagtggctctgtcattttaaaatcccactagcaatggatgagagttccaatatctccacatccttaccaatattgttattttatatttttataattataattttcctagtgaatacgcaatggtatctcattgtgtttttggtttgcctttccctaatgactaatgatgttgagcatcttacaatgtacttgttaactatttgtgttctttagagaaatgtctattcaagtgccttgtccattttaaaaatcgagttgtcttgttgacttatgagttctttaatacagtaaacgcttatcagatatgatttataagtattttaacccattctgaaggtcaccttttcacttttgtggtagaccattatgcacaaaggttttaattttgataaatccaatttatccgcttttgttgttgtttttgttgttcgtgcttttgcaaaacctagtgtcatgaggttttctcattatctttggagaattttatagtttgggtctatacatgtagattattgatctaatttccattaatttgtgtgtatgctacgaggtaggggtccaaattcaatttttgcattgaattgaaaattcatattttcagtttcaaatttcaactgcatattcagttgttgcagcacaatttgttgaagagatcattctttaccacagggaatgatctgggacccttgtcaaaaatcaattgatcatagatgtatgggattatttcagactttagatcttgttccatgaatatgcctatttttatgccagcactgcagtattttcattactgtagctttatcataaattttgaaatcaggaagtatgtatcctccaagtgtgattttcatttgctagagtgttttgactatttggggtctttgcaattccatatgaatttcagaattggcttttcatttaaaaaaatggtagttgagattttcataggaattatattgaatctacagatcactttgggtagtattgccatcttaacaatattgtattccaatccataaacacggatgtattgccattcatatctttttttcttttctttcggcaacatttagtatatgacacttgtaactccttggttaaatttatacctaagcattttatcctttctgatgctgtttaaatggaattattttattaatttctcttttagatggcttgttgcaggtgtatagaaatagaactgattattgtgcttttattgaattatctgaaactttgctgcatttattaactctagtaggttttttttttctttaaagttgtctatatatcttgctctgtgaatagataattttacttcttgatctccaatatggatgcctttctttctttttcttacctaattgctgtagctagaattttcagtataatgtatgatagaagttgttcacaactatccttgtcttctttctgatcctaggggtatagctttcagtctttcaccattaagcacaatgttagctgtggggttttcttagatgccatttaatatattaaggaagtgctctgctatttctaattggttgagtatttttattataaaatggtgttagattttatgactttatgtactgcataattgagattatcatgtggtcttttcattcgattaatgtggtatattttatgattttcatatgttgatccacctttatattcttggggcaaatcccactgtgtacacgggttttttagggtctcctaattttcttcattctttttcttttctctccctgagactgaataacgttaactgacctatcttcaagtttactattttttcttctgctgttcaaatctgcttgaacctatagagtgaatttttcattttacttattgaacttttcagctccaaaatttctctttggctactttgtataatatctatctctctatagatattctctatttggaaagacatttttctcctggttttctttacttatttgtattttttaaagtctttaagcatatttgagacagttgatttaagtatttgtgtactaagtccattgcctaagcttttgcatagagattttatattaatttcttttttttctgtgaacaggtcttttttttttttttttttttttttttttttttagaaaactggacattttgagtagtataaacgtggctattttagaaataattttcctccctccttaggttttgtttccacttgttgcatgttgctgttgtttgctcattagtgacttttctaaagtattttgaaaagtctgtgttcttgatcatgtgggtccattgaattctgtattctgttaatttcatagtcagctagtgttctgaaagttcccttaagtgcatagagccaataaaagaaaaagaaaagaaacacagaaaaagaaaagaggaaaaaaggagggaaagagatttaaaaaaataatgtcggttgggcatggtggctcatgcctgtaatcccagcacttttgggaggccgaggcaggcaaatcacttaaggttgaccatcctggccaacacggagaaaccttgtctctactgaaaatataaaattagccgggcatggtggcacatgcctgtaatcccagctactcgggaggctgagaggtaggagaatcacttgaactcgggaggtggaggttgcagtgaactgagatcacaccactgcactccagcctgggcaacaagaatgaaactccatctcaaaaaaaaataataataataatgcctttgccgatttgctctgtgtttgggccctcattcaatgcctagtcaggccatttacaactctctcttaactttcactacctgcttgtgtactgactgaaggccacctataggtgaaagcttaacatcatctcagatctttttggaccatgaatcctaccctgggtatgcacatgatcttcttaatttcccagtagatgcaagagttttagtgttttaaaagtccttattccctcatctatcttcttttctgacctttttcagtctgcttattgttcatctgaactgacatcctttgccccaagcggctgtggcaaaaacttttacctttaaatgctttcaccacaagccacttgggaagctgccccagacctgggactgctctgaccctgatgaaacaaagacaagaccttgtacagccaggcagccataagacaagtccatacccaaaccacagttctttcagaataaggtctatattggattctctggccctagtaaccagcatgagtctgggcttgccatcttcatggccacttgtcttagtttgctagggctgccataacaaaatatgagagactgagtggcttaaacaagagaaatttattttttcacaattctgaagaccagaagtccattactctgaaatctctctccttggcttgcagatactgccttcttgccgtgtcctcacacagccttttctctgtgtacacatccctggtgttttttaagcctgtccaaattttctgttcttctgaggacaccaatcagattggattagcgaccacccatatgatcattttaccttaagtacctcttcaaaggtatcagagtagtatatttgctacagttgatgaacctgcatacaacatcatcacttgaggtctgcagtttacattagagttcatcgttagtgttatatattctagggtttgttttgttttgagacagaacagagtcttgctgtgttacccaggctggagcgcagtggtacaatctcattgctacctctgcttcccagattcaagcaattctcatacctcagcctcctaagtagctggaactacaggcgcacaccaccatgcccagctaattttcgtatttttagtggagatggggtttcaccatgttggccaggcaggtcttgaactccttgcctcaagtgatctgcccgcctcagcctcccccagtgttgggataacaggcatgagtcaccatgcctggccttattctatgggttttgaaatgtataatgacatgtatccatcgttgtagtattagatagaatagcttcattaccctaaaagtcttctttgcactgggttgagttttaaaagctctttgattattttatgacagttccttattagatatatcttttgcaagtatttttatcagtctgtggttatcttgtcttttacagagcagtaatttttaattttaataaaatccaatttgtcaattacttatctcatatgactctggtgttacatctaaaatgttaccaccatactcaaggtcacctaggttttctctaggaattttatggttttgcattttacatttggtgtatgacccatttgaagttaatttttgtgaggttgtaaggtctgtgcctagattcattttttttttttttggcatgttacttcagtattcataagaaacattgttctgtaatcttctttcttatagtatcttagtcttgctttagtttttgggcaatgctggcctcactgaataaattcaaagtgttccctcctcttcaattatttggaaaagtttgagaaagactattgttaactgttttctaaatttttggtggaatttaccagtgaaccaactggtcctaggcttttctccagtaggtggttttgattatgctttcaatctctttacaagttacacatctatacagacttttataattcagtcttggtaggttgtgcgtatttaggaatctgaccacttcatctaagttatccaattagttggcatgcaattattcgtagttctctgaataatcatttttatttccacaaaattggtaatatcccagtttccattttttatttcattgaatcttcttttttcttagctaatctagctaaatgtttgccaattttgttgatcttttggaagaaccaacttttgatttattaattttctctactctttttctgttctttatattatttatttccacactaatctttactattttcttccttctgttggcctttaattttttttttttaatttttaaggtgtaaatttaggttgagaaattttttaaatgaaagcatttagagctataaattttccttctggtgttcctttcactacctgccataaattttgatatgttgagtttttgtttgtcttggagtattttctaatttgtcttctaatttcttccttgacctattggttatttaaatgtatttaatttttgcatattgtggatttcccagttttccttctgttattgatttctagttttattccattgtgatcacagaagatattttgtataatcgcagtctattaacatttattaagtcttgtggcctaacagaggatctatgttggagaatgttccaagtgcaattgagaatactattctggtgctattaggtgaagtattctctatatgtctgttaagtccaattcatctatagtgttgacgtttcctgttccttactgattttctgacttattattctatccattattaaaagtggagtggtaaagtctctattattgtagaactctctgtttttcaagtctatcaatatctgtttcatatattttggagctctgtttgctgcatatgtgtttacaattgttatatcttcttggcaaattgaccagtttcatcaacataaaatataattcttattgtcttctaacagtttatttttctttttacataaagcctattttatctgatcttagattccctcacactccaccccagcacgcttttggttacatttacataatatatcttttccatcctttcattttcaacctgtttgtgtctttagatctaaagtgaatgtcttacagacagcataagctatgtcattaaaaaaatccattctgcttatctctgccttttgactggggagtttaatccatttgcatttaaagtaatcactgatcattaaatactttcagtattttgttgttttatgtatgtcttataactcttttgctcttcatttccttcaatattgcctttgtgtttagcttatctttttgtgtcacactttgatccccttctcatttcttttttatattttctttgtggttaccaggaggacaatgtatcaacttttaaagttattacaattttatttttttaaatctctcccattcggggattttaggaaggttaaataataatgtaaatgagatacctagaacaatataagcattcaggaattattaactcaattccaatccttcctccacctccacctctttctctgtgagattatagaaaagatgacaaaaaggatgttttctgagccctttaattgttgagaatgatctttgagaaaaagaaaaaaaatgaaagcactaggaatgtacaacagcctggaagtataattaagtgtaaattaaatagataaaagttataagcagaggaaagtatagtagaactcagtatttaaaagagaatcaatgtgaaaattatataaatttatgtaaaataaaactaccagacaaatctgatatccttaggatttttctttctttcatgtgatttctaattgctacatatgacactaaaccattgatctgagctgtaagagaaactggaaattgttctgttatcttttgtaagatttctagaacattttgccctcagacttaaatgccaacgtatttctcacttattgtttactgcttttggatttacatatgatttgattctttcttatctcttatccttacaatgtaattcaaactgatgccaatttaagttcaattgcgtacaaaaactctactcctatgcagctccgccccatctaatttacattattgatgtcgcaaattccatctttgtacatagtttacatattaacatggatttatacatttttatgtatttggtttttaaatcctgtagaaaataaaaagtcaacacaccaatattaaaataatactggtttttatatttgtccatgtgcttacctttatcagtgttctttacatctttatacgggtttgagttactgtcttgtgtcctttagttccaacctaaagaactccctttagcatttttatagggcaggtctagtggtaatgaactctctgagtttttatttagggatgtcttaatttctagctcctgtttgaagtaaatttttctggatatacaattctctgttgattgatttttgttcattttcccttcagctcttttaaatacattatcccactttcttctgccttccaaggtttctattaacaaaattcagcttataatcttattaaagatctcatgtacatgagtggcttctctcttgctgttttcaagattctgtgactttggtttctgatagtttaaatataatgtgtcttattgtgggtctctttggatttatcctagagtttcttggtcttcttacgttggtatatccatgtatttcaagacatttgagtagttttcagccattatttcttcaaacaatctctcctctttggggacttccattttacctatattggttcttttgatggtgtggcaccagtcccctagactttgttcacttttttccagtcttttatttctgcttctcagactcaacagcttcaagtgttctgtattcaagtctgctgactctttcttcttccagctcaaatctgctgttggatccccccttgtaaaatttttaattccattttagtgtttttcaagttaagtatttttattaggttcctttttataatttctttttgttgatattctcattttattacacataatttgtctgatttccattagtttttttctttgttttcctttagctctttgaaaatatttaagacattttaaaagtctttatccaagttcaatttctatggttctgtagagatattttctgccagtttatgttcttcttttccatgggccatgttttcctgtttctttgtatactttctaatttttggttgaaaactgagcatttgaaaatagagccaactttcccagtttctgcagagagtctttatgccacagtattcgttcactgattaactgggtatatctaagcttagggagcagctgagtcaaaagtttaaggtcttctcaggtcttttctgagtatacatgtttcctatgcctgtgtgaaatgttctcaatttccctatataaacagctacttcttcttttttttttttttttgagatggagtctcgctctgtcacccaggctggagtgcagtcatctcagctcactgcatcctccacctcccaggttcaaacaattctcctatacaggtgtgtgccaccacgtctggccaatttttgtatttttagtagagacagggtttcgccgtgttggccaggctggtctcaatctcctgacctcaggaggattacaggcttgagccacagtgtccagcctaaacagctacttttgaatgctttaatttcctgaatagtctcaacccagtttttccttgaggtcttaggtggtccattgtatgtctccacccatagttgcttgccccaggcatctgtgggtctgtggtaccactgcagctttcaccacctgtagctgccacctttccctatctgagatccaggttaggtgagagagatcattccttcacgcagtcccatgacaggttggaacatttcaaataaggtctgttctgctcctctggttgaagggagaaaattgggaaccggtttcccaccttctacaaaccaagatctcatgttgccacgggagtggcagggcaagtgcaagtgaaaatgccatacaattttctaccattttgaacgcgggtttttcttcaatggtcatttgcttggttgctgtaggcctttcactgttttccagagctcccataagattactttagccagttttttgttctttcctgatgcttccctggcagagtaagggttggaacttccaccattttgctgattcataactctgtagtcagttttaaatatattgatacttgagtttgttttatggcccagaatatggtcttggtaaatgtttcacatatactcagaaagaatgtgtattctgatgttgttacatgggctgttctataaatgttacttaaggtggttaataatgttgctcaagtcttctatattcttgctgattttcttttatttatttattttattttttttattatacttttaagttctagggtacatgtgcacaacatgcaggtttgttatatatgtatacatgtgccatgttggtgtgctgcatccattaactcatcatttacattaggtatatctcctaatgctgtccctccctgctccccccaccccatgacaggccccagtgtgtgatgttcccctttcctgtgtccaagcgttctcattgttcaattcccacctatgagtgagaacttgcggtgtttgtttttttgtccttgtgatagtttgctgagaatgatggtttccagcttcatccatgtccctacaaaggacgtgaactcatccttttttatgactgcatagtattccatggtgtatatgtgctacattttcttaatccagtctatcattgatggacatttgggttggttccaagtctttgctattgtgaacagtgctgcaatgaacatacgtgtgcatgtgtctttatagcagcatgatttataatcctttgagtatatactcagtaatgggatgggtgggtcaaatggtatttctagttctagatcttgaggaatcaccacactgtcttccacaatggttgaactagtttacagtcccaccaacagtgtaaaagtgttcctatttcttcacatcctctccagcacctgttgtttcctgactttttaatgatcgccattctaactggtgtgagatgggatctcattgtggttttgatctgcatttttctgatggccagtgatgatgagcattttttcatgtgtctttggctgcataaatgtcttcttttgagaagtgtctgttcatatcctttgcccactttttgatggggttgttttgttcttgtatatttgtttgagttctttgtagattctggatattagccctttgtcagatgaggagattgcaaaaattttctcccattctgtaggttggctgttcactctgatggtagtttcttttgctgtgcagaagctctttagtttaatgagaccccatttgtcaattttggcttttgttgccattgcttttggtgttttagacatgaagtcctcgcccatgcctatgtcctgaatggtattgcctaggttttcttctagggttttttatggttttaggtctaacatttaagtctttaatccatcttgaattaatttttgtataaggtgtaaggaagggatccagtttcagctttttacatatggctagccagttttcccagcaccatttattaaatagggaatcctttccccatttcttgtttttgtcaggtttgtcaaagatcagatggttgtagatgtgtggtattatttctgagggctctgttctgttccattggtttatatctgttttggtaccagtaccatgctgttttggttactgtagcctcgtagtatagtttgaagtcaggtagtatgatgcctccagatttgtccttttggcttaggattgtcttggcaatacaggctcttttttggttccatatgaattttaaagtagttttttccaattctgtgaaggaagtcattggtaacttaatggggatggcattgaatctataaattaccttgggcagtatggccattttcacgatactgattcttcctatccatgagcacggaatgttcttccatttgtttgtgtcctcttctatttcgttgagcagtggtttgtatttctgcttgaagaggtccttcacgtcccttgtaagttggattcctaggtattttgttctctttgacgcaactgtgaatgggagttcactcatgatttggctctctgttagtctgttactggtgtataagaatgcttgtgatttttgcacattgattttgtatcctgagactttgctgaagttgcttatcagcttaaggagattttgggctgagacgatggggttttctaaatatacaatcatgtcatctgcaaacagggacaatttgacttcctcttttcctaattgaataccctttatttctttctcctgcctgattgccctggccagaacttccaacactatgttgaataggagcggtgagagagggcattcctgtcttgtgccagttttcaaagggaatgcttccagtttttgcccattcagtatgacattggctgtgggtttgtcataaatagctcttattattttgagatatgtcccatcaatacctaatttattgagagtttttagcatgaagggctgctgaattttgtcgaaggccttttctgcatctattgagataaacatatggtttttgtctttggttctgtttatatgatggattatgtttattgatttgtgtatgttgaaccagccttgcaacccagggatgaagcccacttgatcatggtggataagctttttgatgtgctgctggattcagtttgccagtattttactgaggatttttgcatcaatgttcatcagggaaattggtctaaaattctctttttttgttgtgtctctgccaggctttggtatcaggatgatgctggcctcataaaatgagttagggaggattctctctttttcctatttactgtacatttattccaccagtgactaaaacaggtgtatcaataaaatctgttccctcaggttttgcttcaggtattttgagggtctgttatcaggtgcataaacaagattgttatgtcctattcttaaattaatctccttataattatgaagttaattttttttttcttgagatgcagttttgctctgtcgcccaggctggagtgcagtggcacaatctcggctcagtgcaacctctgcctcctgggttcaagcatttctttgcctcagcctcccgagtagctggggttacaggtacctgccaccacgcccggctaatttttttgtatttttagtagagatggggtttcaccatcttggccaagctggtcttgaactcctgaactcttgatccacccaccttggcctcccaaggtgctgggattacaggtgtgagccactgcgcctggacctggcccgaagtaaacttctttacccttgctaatgatctttgctctgaagcatgctttgctggtattaatatagtcattccttctttctttgattcatgtttgcagggtatatctgtttccattcttttacttttaacctattgtctttatatttaaagtgcatttcttgtaagtataattggtttcttaaaatccaattatctgccttttaaatgtcatttttatatgatttgcataaatatgattattattacagctaaattgaaatctgtcatcttgctatttggtttctatttatcccatttttttcccctctttttttgctttccttgagattgaacattgtattagttttctagggttgctgtaagaaagtgacataaagtggatggcttaaaacaacagaaatttattgtttcagtttggaggctagtcatctgaaaccaaggtgtcatcagggccgtattctctctgaaacctgtagggaagaattctttcctgcctgttctagcttctagcattttccagcaattcttggcattcctttgcttgtagatgtatccctccaatctctgcctctatcataacatagccatcttctccctttatctgtctattcttctcatcttataagaacattaattactgaattggggcccagcatagattaggcctaatctcatcttgaataggttacatctgccaaagattcttcttccaaataagatcacttttacagcttttacaggtactgagagttagaacctcaatatatcctttggtggggaccgacctcttacccataaaaagtattttatatgattccattttatctcctttttaggttattaactacaatttttttttcttttttttgagatggagttttgctcttgtagcccaggctggagcgcgattttggctcactgaaacctctgcctcccgggttcaagtgattgtcctgcctcagcctcctgagtagctgggattacaggcatgtgccaccgtgcctggccaatttttgtatttttagtagaaacagggtttcaccatgttggctagggtgggtctcaaattcctgaccttaggtgatccacccacctcggcctcccaaagtgctgggattacaggcgagagccaccacgcctggctttataatttttttttaattcagtggatgttttagggtttatagtatacatctttatcacagtctagctccaagtgatatatccctttatgtatagtacatgacccttacagtagtgcatttccatttttcctctctggcatttaggctattgcacacacatacactcaattcatccctttgtgtagatccgtatttccagctgctatcttttgcttctgtctgaaatatatgtatgatttcttttatgactattttgagaaatttggttatgtgcatttgtctatttttcttatgtacttttagctcatcaatcttaagtctgtgagtttatagtttttaaaaacaaatttgaaattatttggctattatttcctcaaatatttttttctgccgcccctgctttccctttccttagggatctctgatttccacctatattactctgattgaagttgttccacgtctcttttgaaaatctctgaaaaatcttttatcatttggataatctgtatttgtacatcttcaagtacattaatattttcttttgcaatgtttaatctgctgttaatcccatgtagtggattcttcatctcaggtattgctgttttaatctctagaaattccattgaagtcttacttgatgaaaaaggcagataaaaacaaatgttggcaaagatatggagaaatcagaatctgcacacactgatgatgggaatgtaaaatggtcaaggcaatttggaaagcagtctggcagtttctcaaaaggctaaacgtagttcccatatgacagcaatcattcatctaggtatatactccagagaaataaaaacatatccacaccagaacttgaacattaattttcatagcaacattattcctaggggtttaaaattttttacattatttttatttaaaatagagacagggtctcactacgttgcataggctggtctggaactcctggaattaagcattcctcctgcctttgtcctgttttctccactggaaaagaataaaactttgtacacttggactaacaactcccgattccctcctttaccaacatgccccacagcctctagtaacttactctctactttcatgaattcaacttttttaagattccacatataagtgagatcatacaatatttgtctttctgtgcctggcttatttctcttagcataatgtcctccagattcatacatgttgtcttaaatgacaggatttaccttcctttaaaggctgactagtacttcattgtgtatatgtatcacattttctttatccacttatctgttgatgggcacttaaattgtttcaatgtcttggctactgtaagtaatgcttcaataaacatgggaatgaagatatcccttcaacatattgatttctgttcttttggataatactcagaagtgagattactggatcatatggttgttctatttttttcagaaacctccatactgtttttcatagcggctgtactaatttacattcccactaacaatgcatgagttcacttttctggacatcctccccaacacttgttatctttcatctttttcataaaagccattatataataggtgtgaagtgacatctcactgtggttttgatttgcattactctaataattagtgtgagcattttttttttttcatgtaccgaatgtcttttgagaaaggtctcttcattcctttgcccattttaaaatcaggtggttttcttgctcttgagttgtttgagttccttatgtattttagatatttacccatttccagatatatcatttatattttttcctattctttgagttccctcttcactgtgttgtttccattgctgtgcaggtcttttattttgatgccaccccatttgtctatttttgccatgcttttgcagtcatatccaaaaaaatcattcccaagaccaatgctgtggagatttccccctatgttttcttcagtaggtgtacagttttaggtcttatatgttaagttttaaatctatttttttatatggtgtaaataagggtctaatttaattcttttgcatgtggatatccagttttcccaacaccatttattgaagaccctgtccttttatacttttcagtatgcagatcttttacctccttaaatttacacctcagtatttaatatttgttgctattatgagattttcataatttccttttcagatagctcattaatagtagatggaaacactactgatttctgtaagatgattttgtattacggaactttactgagtttgtgtatcagttctaccaggttttagttttgttctggtggagacattacagttttttgtatatggttatgtcatcagtaattacagatgatttaacctattcctttcctattaggatgccttttttttctttctcttgtccaactgctctggttaggacttctagtactatgtcaaaaagtgatgagggtcgtacatggcctccatacctaatctgttgagagtttttaccatgaaaccaggttgaattttgtcaaatgctttttctgcatccattgagatgatcatatgatttgatttacaccctccattttgttatgtggtatatcacactttttgatgtgcatatgttgaaccacccttgcatcctaaggataaatcccacttcatcatggtgaatcattctttgtattcgtgaatccagtttgctaatatattgttgaggatttttgcatccatgttcatcagggatattactttgtaagtttctgtccttaaagtgtctttctctggctttaataacagtgtaacactacccttgtaaaatgaatttagaagtattccctctgcttcattgttttggaaaagtttgagaatttttattagttctttaaatgtctggtaaaattcagtagtgaagctgcctaatcctgggctttcctttggtgggatactttttattactggctcaatctcttttcttgttattggcttattcagatttgtttcttcatgattcactctttgtaggttgtatatgtctaggaatttattcatttctttaggtcatccaatttgatggtgcataacttcatagtagtttcttataatcctttgtattttggtgatatcagtagtaaatgtctcctctttcatttctgatcttatttgagtactctttttttctcctagtctaggtaagaatttgttgattttatctttcaaaaaaaaaaaaaaccaactcttagcaactcttagttttgttcatttttttccagtctttatttcaactgtgatctttgttacttacttctttatgctaactttcgggcttagtctgttcttttcctagttcctttaggtgaaaagtgagattgtgatccttcttctttattggcgtaggtttgtatcgctataaatttccattaggactgattttgctgcatcacataagttttgtttccattttcatttgtctcaaggtaattttttatttactttttgacttcttctgtgaactattagttgtttgggagcatattgtttaatttccacatattgctgtattttccaccagaattgattcttgttcttgatttctagtttcacgccattgtaatcagaaaagggatttgatatgatttctgtccacttaaacttaagattagttttgtggactaacatatatcctggagaatgttccatgggcatttgagaacaaaatgtattttgctgcttctggatggaatgtttcatatatgcctgttaagtccgtttggtctaaagtgtaattgaaatccattgtttctttattgattttctgtctaggtgatcaatctgcccatggtgaaaagtagagtattgaggtcccgtattatagtattgcagcctatctccctcttcacatcatttaaaaattgctttatgtatttaggtgggtcaatgttgggtgcatatacttttacaattgttatgtcttcttggtgaattaatccctttatcattatataacaaacttctttctttttatagtattgacttaaagtctattttgtctgatagaagtatagctacccctgctctcaatttccatttatatagaatatctttttccatcccttcactttcagtctatgtgtatgtttagtagaaaagtgaatctcttgccgggcgcagtggctcactcctgtaatcccagcactttgggaggccaaggcggcgggatcaccagaggttgggagttagagaccagcctgaccaacatggagaaaacctgtctctattaaaaatacaaaattagccaggcgtggttgtgggcccttgtaatcccagctactcgagaggctgaggcaggagaattgcttaaacccgggaggtggaggttgcggtgagctgagatcatgccattgcactccagccttgacaatagcaaaactccgtctcaaaaaaagaaaaagaaaaagaaaaaaaagtgagtctcttataggcagtatgtggttgtgacttaaaaaaaaaaaaaaatccattctgtcattctatgtctttttgttggagaatctaatccgtttacattcaaggtaactattggtaagaaactgctagtgtcattttgtaatttgttttctgattgttttgtaggtcccttgtttcttttttccctattgctaccttcctttgtggtttggtggttttctgtggtggtgtgctttgaatcctttcttttatagtatatgcgattaccattgtatttgctgtaaggctaacttaaaacattttatccttaggctactttaagcgataaaaacttgcctttagttgcatacaaaaactctacgctttcacaacccccccgcctttcgtgattttgatgtcaaagtttacacttttttaaatttgtatctcttattgtagctacagttacaattacttcttgtagctacaacttattgtagctacagttgtttttaatagtttcatcttttaaacctcctaataggaataacattgctttacctgccacctttacaatactagagaattctgactatgaattacttataccatttagttttttacttttatgtttctcattaactagcagtcttttatttaagcctaaagaactcccttttagtaattccagtagagcaggcctagtagtgacaaactcccttaggcattgtttatctggaaaagtgtttatttctccctttgccaagtaaagtattcttaattaacagctttgtttccttcagcactttgaatataccatcccactctctactggcctgtaaggcttttgctgataaagccactgaatctgtattggggctaccttgaatgtgatgtttcttatctttgctgctttcagtattctttgtctttgatttttgataacttggttgtgatgtgtcttggtgaactctttaggttgaatctgatcggtgacctcagcttcctgttcctgaattttgtcatcttttctcagatttgggaatttttcagctattacttccttaaatatgctttctaggcctttttctttcttttctccttaaggacctcctattatgcaaaagttagctagcttgatgtgtcctgtaattcttataggcattcttttttgtttttgtttctcattggataatttcaaatgtcttacctttgagctcattgattcttctgcttgatcaagtctgctgttgaagcgttctacttagattttcagttcagttactgtattctttatctttagaatttctattgtttttgtttatatttgttaaacttctcattctgttcagatgttgttttccaaatttcatttttctatccatattttcttgtactttgttgaacttaagaggattagtctaaattatttgtcatttcacaggtctccatttcttctgagtctgttactggagctttcatatccaatgtacaccagaaactttgctaattccacagtaaatgttagaaatgggtttttattgataaaatcagtggcttgctaattagtatgttagaagctggcttgcattggtgaagttgagggtattcgatatacgtatcccggctaaaatacttctaaagaacctctccagctttgcaagaatagagtataggaatctgaggaggcctttaacatggccctcagaaaggacacacagggcttgacctctaaacatataaacatatacagaaacgaggtcagaacatgttttgactgatgccagtagtaacacagcagagcctattgctggtcactgttaccaataccttgtgtaataaacctttcatttaaattgagaggttgtaagccccgaaaaagcaaagggcttacagtacctcttgcctgaacactcctgtgtgtgctttctaagaaatgcttttaaaataatgcctgtggcacaaattgatttgacactggctctctttataagctgctatcaaggttgtggggaatagctaactcttacccactttccctgacaaataggaacccgtagttacctaccaaaagtatgtaaaagctatatccgacccaaaggccagttaggtcaaaacaccttgaaaggagctcagtttaaggaaatcagtggtgtcacagtgccccactagcgtgtaaaagttttcatagtttgactatcggatgtgcttagtttcacagctgagtcttaccttgtgatacttttagagcaaaagtcaaatcaaagatgatttaaaaaaacatttcaaagattcataaagaataaatgcctcctcaggaagtcttctggagttctgcccacttcccttaggtggctctttactgtgcccatctcatagcctgtctccttccacttggtgtattgcagagtaaagctcactgtttacaggggtggtagaaagtgtggtcctttcccagactcctttttcccttcctcttctcatttttcagaagatgtgtttgataataaacgaaacaaaatgactaacacattgagctgagctacataagcagatgtcagtttgacgtgaagagtttaaaagatctatgcattatctggggactcctcccccagacctgaaggatcaggtgctgccttctatgccacctgtgcagacagcaaaagaggaaaaccatacccacgttcagtatgaacaaaggggacatttgaactctgtgtggacccctcattggaagggtgtttcttctcctgctgcatccacaaagagcactccttagccttgccttttgtcagttctctctccaataaggcttgagcagagacaacccagtgcagttcagagagactgaagtctggtgttccaggtctgagtcctagctctagctctctgtgtaactttgggatgtcccaaagtaacttttcacaacttgataggtgttaacttgaattttggatacaggtgactcttagcccatcccctctctgtgcttcagatatgtcatcacttgggccatatgacctctggacacctttcctactttccacaatttcagagcagcagagcagactggagctcctgctgcctctgagcttcagtgaattatcactcgttggagggaagcttcaagcattttgttatctttcaagagcaaacacagtgtctgtcagcaagaatatgtagcagatgctagtgaacagcagtgattagggttgaatgctggatttaaatatggagcttaggctgtgaaggaagcctgaagaacctagagccccatgaagctgccctctgtgagatctgacaccatttcccactgatgagccatgggtctaatgggtagcactgattccacatacagtatgtgagtgcaatacagtgaaagcaaagagaataaaatgatggctaacatgatgttccaaactttaaacaggagaaaaacacacaattccattatgtataagaacccacacagagatcaggagaataacctcattggagaatgaatgacctgtgtggggaatttagggtagagttgagattgaaaaaatgggccgaagtcaggtggccaagggccttaataccttgtatacaagatgtgtagtcaaggaagaccatgccttacttatgcatcaattcccttgggcctacaaagagctgcctagcctgggactgttgtagagaaaagctacagtgttccaatgacacagggactcctccatgtatgtatgagtgcccagctggctctgtaataaatcttatttttatttattaacttttcttgcgcattggcttgatgcatcagttggaagtcagaggccaaacgaagtgaacactgagccaaaggaagttctcagcctttagggaggcagaattcactttaaacacaataaacaaatgaactcacattatacaggagagagtcagaagatcccagtggctggtgtcatcgggccatatttgcccgaagtgcctattccttataggaacccactcccagggttgatgggctacatccttaggaggctttatgcctatgttctcctgaccactggctcctccagggctggccttttttagtctctctgtagaggttcctgtagctggttggatataggctttcacagaagggtcagtgccttgggtctggttacaggactgttaatcttgctttgttaagagtaatgttatttccccatttccaaattctccagggagatggaatgtcaaagatagtatgactgtagcacctaaatcctgggttccagaagcagagaagagaatacactgaagctgtagaaaggcctattagtccatgtcagagattaactggatgcgaggaccatttctgggatggtgtatacagaactggagaactggatagggagtcagaaacaaagagctgaagatgatgcctttgaagtttccaacgtggataactaggtcaacagaatattactcaagaaagtattaacataggattgagatgcagtcagtagtaatggaattgaaatttcaaagtatatacctcatggatctcagggggtgttgagctgatcacctgggctaacactcctatgaccctggggaaaatcaaatgacctggtactgtagccatggtaggggtgtcatcaccttaatccaactgggacagtgctgtttgatattcatctggaacttggtgcagacccacattttgctgggtttcaccacaaccaaggcttttttgattcttttctcttttaacatcagtacatcactgcaaagttaatcctcatataataggagatgaaactaattgcttataaaaacaagatttttacaacactaaaattgttcaagcatatgggcatatttatagttgcaggcagtgtttcagatgcagactgttcttggctgcagtggttgtttacaggcagcatctgttctgattaaatatttgatgattatccccgaatgttttaaagcatagtactgggctctgctgactgtacaacaaactggcatttttgacctatagggcactgggctaggagatacagttctgagggaagtgaaagatagttaacaactgcacaactgaccctttattagttgcaataaagcaatccaaccacccaacccactgtgatggctttcctactatttaaggttggtggtgtcaaagagacaccctcctgtacagtgtgcagtgaatcaacatcatttccacaaaacctccttcctgcacaaaggaattatcatactttgttacgaagtaaaattttcctgtatcagtcacaggagttcaccagttaagatactgttagttgaagacttctggggtgacttaatgaaatagctcagccatctggtttaaaaactggattcttctatccctccacacagctgtccatgcacctgcatcatctcaaggctggtctccctggtggtagaaaggctgacagtaaaaactggagccacatgattccttgcttaggcagtgtttcttcatactctcacatgagagcaggcatgttctttccctaggctcacagtaaacactctgtcaaatctcacaggcccaaagtgcttttggttatccccattccaagccaatctgtggcatggaagatagcattaccctgactgccttagactaatatacctactccacttctggggctgggaataattttgaggtcaaccatccaaactgcatgacagccattccatggaagaggtatggcctaaatctttggggcaacctgaattcatgaaaactctcttagatttatgtaactatttttagaattcacttctgtatcatttaattttactaataaaaataccacctttaccctaaatgtcagccaagcgtaaggctccgttgggacagaaggaactatcaaagctttgtgtttttatacattagcagcatttgacaaagaaataactctgaaggaaggagaataaccaggcagagtctagatgcatggaaaagaagtctttgagaaggcttcgcaggctgaaggaaagggcaggactacttcaggaatacaacgtttaagtaaaagaggttggggtctgttgatcttgaggagagatgaggatggactggaaaataggagtgagatatagtaggagaggaaaggatatggatgatgtatatactgtatgggtaaccatcagtcgaccctaagaagataatagttgttaaatggttagctatttaatgaaagaaacctgaacaagtaataatcttgagttgcaaagtggctggagtcacacaacagactaaatttctggtagaacaaatccagcagcttatgtgaaggttaccatgtctgaagctggatagaaaaggtctaacttccaaccaaagtcacagttcttgagctcggtacacagagacagactgctaacagctgatgtgtcctcagcgagagtgtcctcatttatatcctcgttctcttctgcctcctttttttgttttaaacttttgggaagtctcatcattcaatacagttctaatatatcacaataacagaggcggcccaatttctacaaattgactaattctatccctgaaaagttcatacaataaaactatacaaagcatcattttcaaccatcctatagaaaaatttccctattaaattttaactctaaatcctctatctctgttaataaccttactaaaaacttccccatcactgcctgccagggagatcaaaagaaaccaaatttaagaaacctccaacacctgtacctgactgaaaagcaaacatacagacctttcagtcctgcccctactattcagctcctatcacagagacatggtggatgtccccttgggaagcggatagctcttaggtggaagctaggcctgcaataagcaggccaggaaacatgtctcccaggccccatactcttggcagaagcacttggccaccagacagcatgtcctgtcaacctacagagttcttaaaaacaaacactgggacccagaatagtaccctgtggtcatagtgcccacagttcactaagcaccctcacaggtctttgacagaacactgactgccaggtcacctggtgggcagagaaatggaagattcccaggcccaactagcatctcagggaagaaccacaagcagagcaactttcagagctggtcggccagcgttggcacccagggaagcaagtgctattccatatttggagagaacataaaactcaaggaaacagagaagtcctactcaataccgttctcaactgaaaacaagagaacttgcaaaaaagaaacccagttttctggagtccatggagaaatatgaagccaatgctcggctaacagagcagaaagccttttataaataatgccagtcaaagctccaaaggtcagagctgatgcatgccggattgttctgacaatttcttaggtttctaggcaacaaggagctggtcaaacagctcacctccaaggacatactttataataccaccctggtagacgagagcgaggcagcagtgaaggcaatagtcaagaacaggagagggaggtaaagaacaagatgctcttcagacagtctggacaaagacagtccctacccagctctcaggagttgcctccttaagaaggtggaggcccaggcagctcccagggtgaccctaaagacagactccaaggaaaagggtgtgagggcaatggtgaatataaggaggtcccctttcagtaggcagagcaagtcagttcaggtcttatttttagagtctctgaacagtgaagagaagctttctgtggacagcattccaccaccatgggaggggaaaggtgccatgagagacttctccagtggggcatacaagcattgtgcagtgatccccaagatccagccactggcaggaaatcgaaaggcaagcttcttaaatacatagtatatggagacagaagtgtggagcactcccaaaatgaaaggccaagacccaggaacaacctccacaacctggagtatatacaaatgaacccagccctgctgactcagatccacaccatcctaaagcaggggtttctcatgaatgaaagggctaagtatttggtggagagaatgagaagtctcccactgcccacacattttttcttcagagatttcttttccaagagccccttgaataaaggaagggagggagcactgaatgccccagaaatcagaatgcatggtgcgggaagacgacaggaaatagttctcaaagagatcagaaaataaattggaagcaatttcattaccacaaagaacagacattttttctaaggcacccctcccctttccacccaattgtcattcagcaactactgaatacttaccaatgaaaaacgttacccctgacctcaaggctgctcctgagctctggtagaaaatgctttccttgtctataaaacatggcaagcaaggcaggatttaacagtaagggcacagtagcactgcaagccttcaaatggaaacctggagacaagcagtgagaacaggaagcaaaagcagggcaggtgaagctaggaccagggcatctggaactttccacacaggttggatctccatgccagacaacagttttcaaggaaaaatatctaagaggaacatgactttgggaaactttttggcagtactgcttactgtatactagagagtaaaagaatttggggaacattcaccaatttgcttcttcaggggcttgggtagggaacgtgaacaggaacctggctctaatttctgaacttttttatcagtaaaaacaatccaacaaacgaaagctagtcagtgagagaactgggagggtctgccctccttccctgagtcaagccttctggggggacctcctgacatttaattaagcaaagacaacgcccactgaaggaagctgacctgaaagtgacacgctactgtgaaatgagcatgaagtgggagcttgttacatatatgaaatggccagcgatcctgagcaaagcgcttcagagcttgagacctaagtcttctcatctatatactgagggctggacaagatgatctgtcaagccatttttatccctaatccaccaaaatccaatgctttagtttattgtcacaaaagcaggtatcgaatggctatcctgcagtgcctccaatcaacattcagactttttccctgaggcaatataagataacagttaacatgtttttatcaattaggtggtcatgagataaatatatatgggaagtggtagtttttcacttaaatgcatataataatggtacagctctctttgaatagtatttgtttatttcttaaatatttaagttcctaaagacggtaagaataacccaaggaagtgaaatcaatgtcacaaagcacatggctaaataactgcaggtttgcagtgccatgtgtgagatcagatgacagaagggagaactacctttaggcagaggcttctcatgtcccctggagtggccatgtgctgttctacatgactacttccacttcggttatgtagaagctatttaaagcacacagatgtttgtgatgagaaaaaagccacccttaattgaataatggaaattataagcatgatttgagggtgggggtggaggtgggagtagagatgggtagaaaggagtgcaatggaaacaaaggagccttcataaaattcaagtcacttcttaggataacgtgattgatttactcaccaccttcttaggaacataaagcaaacaagtgggttttccttttactgcttttctgaaatgagctacactcaagaaagcagcacgggggttgtgctgtccctgcacagtggcaggagagtatgaggagcaggtgaatgccacaacagctccatccaagatcatttttcacatgcaggaaccattcttatactaccctttactggtaatttctgtagaaatctggaagtctggttgacaccctcctgtacagtgtgcagtgaatcaacatcatttcccttggactttgcaatcacggtggcattcatacattcattcaacaagtatgtatgtacaggacagtggagtaaagaaaacagatagttcttactctcacgaggcttaaaatttcaggagggaactaggcagtcatgaagtaaacataaaaacacagattgtaataggcactagagaataatgaagactttggggaacacaatttaaattggaaaaatatctcagttccgttaacacatgttgaaggggaatagcattgttttgctggatttggggcctggatgcaagcatgttgggtatgcattgtagggtaatgcatttccttccatttgggcccaagtgtatatttaccacccagttgtgatgagctgggatcctcctgctcaatctcagcttgaagcacttggaggttatctgcctgctgtgggtgattattttggagcaaggtacttcatttgcctcaagaaacagatttgataccactactgtgcccttttggaacagagaagtaggcaagaccccagtgtgaggcagagtgatgggatctttagggacataattgatgatgtaactgatgatgattttggagtttatacatttccaaagtttcaaaatattttcacttggttgatttatctttatggtgatgacactacgtagatatatgcccttcttaaaagttacagtaagaggctgggagcggtggctcacgcctataatcccagcactttggaaggccgaggtgggcagatcatgaggtcaggagattgagaccattctggctaacacggtgaaactccgtctctactaaaaatacaaaaaaattagccgggcgtggtggcgggcgcctgtagtcccagctactcaggaagctgaggcaggagaatggcgtgaacccgggaggcggagcttgcagtgagctgagattccgccactgcactccagccagggcaatgagcgagactccgtctcaaaaaaaaaaaaaaaaaaaaaaaaaaagttacagtgagagttgacattgagaaaagggaggcccagccagggttatgcaaagacacagtagggaggaggatgggaagtttctgagacaccccagtaactgcatgggtccacaaagcacatgtacagtctgctctatgcactgcaggtacagccacgaataagacaaagtctctgccctcatggagcttggtgtctgtctactggagcagacaaaaacaaacctgctttttctcatttgcctctactgtgggttccgtgtataactctcaaatgctagcatttccatgcattccatccttgtccttctctcctctctgccttttccaggagaattttcctagccacaggttcagctatggtctatgtgctggagtcatacatttttatcttctgtgtacgtttttctctagacccatatttttaattgccttaggacagctctccctggatatccctcagacacaactaaaacatcattcaattgtactattaataattttcccttcaaaatccactcctcttctctatagacctaacagcaacactgtccgtccagctctcaaaacctgaaatgtgggagttgtctttgactcttatctttcccatgcatgagcactgaatcaatcagagtccctagcatgtcttggactgtggcctcccttctatcttcagattatctgcctttttagaattatggcaataacttaactgcaaagaccacatgtgcacttgtgctctttcagtttgtaataaatataaaatgaaaagtgattatgtctttgcttaacgtctgcaaaataaaagtccaaagtccttggtatggtctataaggccctcattatctgacctgcctgccttcccaatctcatcttaatcccttacagcctgacactcagacatactagactttccacctaactcactcacatacacctatcctgtatgtcaagattcggcttgaccttcatcacctacctatctgcagtatttttggatctgaattctctgcccacattgtactttcacatacttcttttacccttagtggtttgtacttatgcctggtctaactagattgtctccctgtaacagacttcttgattcaacaaagcagctctgaatcagcctgaaacctatggcacactgcaaaatggcaaacattcaataggtatttgcccagtaaatgttaatgaaaggaaaaaaattcaaacttcagttggaataggattagagacaagttaaaaaaaagtttcccatagaaatcttcctcatcgtaaatatcatcatcctaaatgtcccgagtctttccatgggtctaatttaccaaatcatgaagactctctttctcactgtgtatgtgtagtgggagaggcagagacagaacggtttttttttttttttgcaagtctgctctctggattcgtttttctggggatgaaatctcaggctatgtagcttttctggtccctttttggtaatcaacaaatcatcagtttctctaggtattaaaaagcctacacttttgaaacaccaagaggccaaactctctcttaattgaaaacataattctgcctcttactgaggtctttgggtgggaagcttaaagacagcagtgttggggcaattggtttttcttttcctccctccaccttctttcccattcaagagctgttgctgccctttctggaggggagggaattagaaaaaaagatcctgccttacccagtcactgttaattattactttgagccagggtggggaatgactttctttcctggaatacaccctgctggaaaccacagctgagattctctaagctggcagcttccaacctctcctccctcaacagcttcaacattatatggcactcagctgcagggtgcctggctccaggccggcagtccatttgtgcagggtagttttcaagatggctcatagcccatctctttcagtgaccagcgtggcctatgggaaacatacatcttgactccattattggtaggagtactctttagttaactgccacaggccagttcagacacgtcttaccctgagagccttttcagagtcaggtaccatccctgtgtcccccagcatctgaagatcacaggtgaaggtctccaagtagttcacttaaaaaatacctcagtaggtttaagaacagggaaagctcccaattcattctgtcaggagtatgactctcatccccaaactggacagatatataatatgaaaactacagaccaatattccttatgaatatagatgcaaacattctaaacaaaatactagcaaaccaaatccagcagcatagaacaaggtttatgtagcatggacaactgagattatcccaggaatgcaaagttaattcaatatacaaaagtccattaatacaacatattaataaaggacaaaacaacatgaaaatcttgatacagaagaagcatttaacaaaacccacagcccctcctttttttttttttgattaaaaaacactcagtaaactaggtttaataaaagaatttcctcaacttgaagcaaacccacagctagctaacatcatactcaatggtgaaagactgaatgctttccccttaaaatcaggaacaagaaaaagatgtctgctcttgtcacttctatccaatattgtactggaggtgctagccagcacactaaggcaagaaaatgaaataataggaatctagactggaaaggaagaagtaaaagtatttctgttcacagatgcatgatctcatatgcaaaaaatactaagtgacaaaaaaagaattttagaaaagctacaatatacaaaatcaatatacaaaaattaattttatttctaacaccagtgatgaatacaaaaataaaaattagaaaataatcatataattaaagtggcatcagtaaaatacttagaaaaaaattaaagacgtcaagacttgcacactgaaatctctaaaacatcactgaaataaagacctaagcaaatgcaaagacatcccacagtcatggaacagaaaacctaacaccattaaaatagcagttatttctcaaatttatctaccaattcaactaaatccctatcaagatcccagctgttttgcaggaattgacacaatgatcatataaaaattcatatgcaatgcaagggacccaaaacagacaaaatgattttggggaaaaaaaaaaaaaaaatggaggacttgcacatcccaaatctaaacttactaccaagctacagccatcaagacagtgcggtgctggtataacgacagacatatagggcaatggagtaagactgagaatccagaaagtcttatatttatggtcaactgttctttgacaagggtaccaggaccattcatggggaaataatagtcttttcaacaactggtgcttgggcagatggatatacagataccaatgcacttatgcaaaaaatggatgaaataggaaacttcactacattctactgcatgctcggtcattttcaatcatttaggtggcaacactgacaagataacagaaagatggaggtaataacatgtgaaaggcaaaatggtttgtttttttttttaaaaatgacagtctctatcatgaatttacttacactccaggcaaaggttattagaagaaaaaaagatgtaagaaaattccttaactgaaatgtggaaagagtatcaagaggagaccctaagacactctgtaagaatcccagtgactcctcactgttcaactaagaaatgtaccccattatgctgtgctaccacggaagcattggaggcactttgggggttgatgaagtcttcatggatgaggtactttaaatatctggtcatgaagagtatttgagaaatatgacaagtgaagatgctgggtaggaatgcagcgaggaaagtgtgtaacacaaggccaaattggaaaggtcagtgagggggcaatctgtggaggcactgaatgcagaggatattaaaattagcaagatagtgttctagcacaatgaaaaggattggaagagggagatgagagtcagggagtgaaattaggcagctgctaagaatgtccgggtgagtcagaggatcaggacctgtaagggcagtataaagaaggaaggaatgatgggagaggtttagggggaaagaagtgacaacctgtgacaattgaggaatgagagattttgatgattggggtgaaggttacatttcttaaaaagaaacaaagaatggtcggtcgatagagatgcaagatgaagaattttgtttttaggactactgactatgaggtaacaaagaaatcccagagacagaggtctgagcaaaagatatgggattggggaagaatctttgggagtgactgaggttgactagagggaactgggcaagaacaggtaaggactttaagcagaattggaggagtatccatctaaaatctgggtaaactgggatggaaaaacaagtagccagagaagcaacagcccaagctagggtgttgtcaaggttatagatgttactgattttggcaatgaggagattataaggatccttgaagactgtactttcggtgaaactaccatgcattagtagcctttcacagtgatatctaccccacacctgcatcaaaatcttgcagtgcctattaataaatgccaacccactaacggggaggggagaaaagacttgggactctgtacttgtaaaaccctctaccctccccaggcaattctttacacactaacactgttgaggtaaaaggagacaagtgagggagcaaatggaaggtgtgtttttggattatacagtggctcatggaagggtgggaggggtacagatggcccttagacactggcggaaagtcagagaaaaaaaattacagtaagcaggtaaagggatcaagactacacagggactagtcttgggacgacatttcttcctctgacagtttgtatggaattcttgagaaaaattcctcgaaggggcctgaaatctcagaatggtcatgtttttaatgggaatagggagtgatgctgccccattacaaccatctgttctaacagaatgtctgtaccgaggagggatgagtaacatcggcaagttctgttcgaagcctttttcaagtttctttttgatatgtatctatctatctatcatctccctatacaagcaagcatccccaaaagtagttgtctcaggaaaccagggttaggatgaccagctcatttgctggagctgccaaggtccagaaaagtttggctgcaggctgttttcatgttttatgtatgtttgaaatgttctataataataaaaggttaaaaaagtttacatttatttggaaaaccagttactttagtttatggttcctttttttccctccagagcttcctggagattgaggtctaattcaaagaaaaccaaaatatataatagagtacctgggcaaaaaaagtacttttataacataacatttggggtagaggaagtatccactgtagtcaaaatgtctatgttttgctcttccttattgttcagggacattccattaaatagtaatgaaaaggcagcaaaagtaagaggagtgacaacatgcccggcataattaagcaagctagagcagctattctgtgcaaccgacgattttttttctctaaaattttaagggtaggttcattctgactctgttaaaagtctacttgatgtgaacaactctatatctgataacctatttcaattaccactttaaaacttgtcatatggatacgttattacaattgtagaactttaataaataccataataataaaacttgagaactgaagagcacacatttcttcacgaatttattatataaaacgccctcagagtatttaatttctcctcactttaattacacattaagaagcacagtggatgagaagcctttaagatgactacagttgcacgaaggtccctttcatcaaggtagcgtatgtaccctaacagtgttctaaaggctggcccagaaaaaccccatgttaccttatcacaatatggaaagcattgtcttctttttccactaaattaaattatggtgaaaagtgccacagttttatttagcattatggtacataacaaacagttctgtctcaattatgaaaaaaattaattaaaataatcctgaaagacatcctttttctccccccaatgatttgaaagctgcatttttcctgccaatttcaaacaaacaaatcatcaggttgatctacagtaatcagttaaaacaatcagtcaatcaatcaatcaatcaccaaggcacaagctcagcacattagctatagcttgtagcaaaaggatatatcaatgtctcaccttagttaaaaatacataatccttttattttataatgcaataaaagaaattaacaacatcacatacacagaagactaggaaaggggaaactacttacttctggaaatcagtaatgtaaacctacttgtacttttccatagtacatgaaagtaacgtttaacatgttttgaattaattaattaaatttaatctgtggggctatacaatgtaattcttaggagtaatagtttcattcatttccaggtcagcttactgtatgattaagtaacacaaggcacagtagccatctttttcattatgttgcaacactgatcacgtgcctcgataaaatggctgattcaacaagatgatggcaacacgaaggggagactttggattgtctatttaaaatctaggtaataagtaagtaattaataaaaactctatcttaagtgcactttcacatgctttttgtttataataaacaaacaacaaacttcctaactttgttgcaataggcttgactaccatttcatttggccaaatgcactttccccagtaaacttaaaacaacaacgagaacaacaagaacaaaaatccctgtcctttcatatactaagaaagaggattggctactgaaacagttcattgcaagacacatgaagacgacatactgtggcatgagttgtttttgtttttaatttgttgtgctgttactaaagttctgagggctgcagttaaaacattccaatttctcccttccttccatctttctttattgattgattctcaagattttgcacagaaaactctttgggggctagaacagcagtaattgcatcacactgttttcaagacttcaagtttcaaaagcaaatcattaaaaaaaatacagttcctgatttgagttagatacagggacaaaaaagtagcacatacttgaaggttacgtggtctacaaatggtggcaatattttccttgggagagtagttctgttggtatatattttttaaatactcaaaaggctcaacctcaagcagtaataaacacaagcaaaagtgatttaacccttaaaataaatattcagaaaaacctctctgtacatacaagtgaaagaatatgtaacactttcacgcaaaaaaataattataataataataaaggatttgttcatatatgtagctgaaatctgctgttccagcccacatgtccccaataaagaagggaggcacagacataggtgactactgtggttgactatcttacagcctttttgtactgggacactatcaccaccaaaaatttatccctcgttatatttttaaaattttttaaattttttctttttttttccttccttttttttgttttattttgttttgttttgttttacagcatgccaaatcctttggcatacgtgatggccttcaacaatctctctttaagtttttctttgcttgagtattccggaagtaaaagcacattaaagcaagtatgagatgtaggtaacctaaatagagaaaaggggaaaaaaacaggaaaactgtaagtcatgggaaatacacttagaattaaatgctcctatttttagattgtatatagttgagacggtctgcaatgcaaactatacattaatgcaaatcataaactttttgttgtgtaactaccaagttgcctttatcctataaattactcaaagctagtgacgatgataagatactgtatccattgagtttttactacataacagataccattttaggtactgaattcttacagttcatttaactaaatctttccacaacaaaaccacagagaggacatcagtaaatgcactttagaggttaggtcactgagaagtcaagtaacttcctctaaggtggagaaaatactcaaacctgttttacaagactgcaaagtgtgtgctcttaaatgcttattagaaacactgctggcaatatgactaagaaaatgatttgataacaggattctagcacaatcaaatgataatcttccgagcctcaatgtaaccattctaaatagatgatcatgttatatggctttcaattaacaagctgggaatcaaaaaagtaaatgaatcacactaatttgattccaaaccaatgtgagccccataataatttttaactagggcaatttcttaaaagtttcctcacacaatgacagcaaagtattttctcaattgtctaatatgatttggggatttgtatataaaatcacgaatgtgctcagaaactataaagacagttcatatgtatgtgacgaggaatgcaaggttttcggtaggtatacagtcacaagttaataattacctacctttctgtgtctgggccatttttggctataatcatctttaattttcctagtcctcccacaggtgctctgtctgtgcccgttgtaaactgcaagaagagtcttttctgttcatctgtaaatgaatgaacgatttcccagaactccctaatgagaaaaaatacaatactggtttcagtttggcattcattatgactggtactaacataagcttatgatttgcattaaaactatattaagagacaacttggaagttaattatcaggatagtatcacttctggtgatttaaaaatttccaagcaaatttatcctgaacagctctgaatacgtaaaaatttagattagattacaatatagtaaaatattagtactacaatagtaaaaaattgagaaaacccaagtgtgtagtaacaggaagtgactatttaaactatggtataatcacattatgcagtcagtaatgagcaaaagacaaaatcctatgaattgaaaaagactgaaatgaatatttggaaaaattaactccaggtgcctttgggtatatattttatttatcctttctcctttattctcctggtctactcatcctttaactcaactttgggaggaaaaagtgatacagattaaggacaaaagaaaaaaagaccccctgccccaaccaactggccccaaatgcaaacaactacatacctaatagcagtaatacaaaagttcaatttttatatgaactagaatactttaaacaagtaatatgtgctgtgtatggaggaggagaattattctgacatttctgccacctgcagttattttaagagaatgatttatcctgtggcattcctaaaatctatgtaataaaagctatgttttaatgacacttatgttagtttgagttctaaaaaacgaaatacaagctcataaagtgcaatcttgaagtttatttgaataatcaggcatctataaaacatatatacactagttcatagctaaataaatttttttttttttgagacagagtcttgctctgtcgctcaggctggagtgcagtggcgcgatctcggctcattgcaagctccgcctcctgggttcgcgccattgtcctgcctcagcctcccaagtggctgggactataggtgcctgccaccacgcctggctaattttctgtacgtttaagtagaggcaggatttcaccatgttagccaggatgggtctcgatctcctgacctcgtgatccgcccaccttggcctcccaaagtgctgggattgcaggcatgagccaccgcgcctggcctatagctaaataatgttaagattaaaaaattaaaaaaaaaattaaaagtatttttagttgcttatataatataaaatgcattttaatagttatttagaaagttctttccagagccaggtgtggtggctcatgcctgtaatcccagcactttgggaggctgaggccagtggatcacctgaggtcaggggttcaagatcagcctgaccaacgtggtgaaaccctgtctctactaaaatacaaaaattagccgggcgtggtggcagatgcctgtaatctcagctacttgggaggccaaggcagaagaattgcttgaacatgggaggcggaggctgcaatgagctgagatcacaccattgcactctagcctgggaaacattttgagccatctcaaaaaaaaaaaaaaatttcatctcaaaaaaaaaaaaaaaaaaaattccagaatgttagcagagaacatcacacatcccaaaccagtaattacaattttctaccttttgatattctaatatcccaacatactatttttattaccaaaatgctggcatttttggtgctgcaacaccatttatctgaaataacttaaaagttttattagaattcttggctttctccaatctcttgccacttcccttccctgcccctttacaaatccaccagtcagcaagagaaaacaaaaaagaaacacacaacaacagaaaactggacatgaaacttgcaggagcatctctcaggtaaggaggagaggaatcggaccccagttcatgatactccttttggggaggctgacaagagaaaacaagtctgctgtagcacagaaccctccaacatagcagaaaagctgccctgcagtgggtggtaataaagcctcctcacactgcaggagggctctgaagcttaactgaaccagctacacctaaggaggtagaccaaagagcaccaccgaagaacagagacagaccctgcaggaagtggcagatcagcagtggtcacaatgaccagtctggctatattattacggagctgtttctttggacttttaaacgaaacctttaaaaattttatacaatgaaaacagggaacaaaatgcatctctattcctataagtgttatgtgtgttacattaacattttgaattaaacaagaatgcatatatttagaaagctgaagaaaacacgaagaagcttccaggtttccacataaaagtggtggctgtatcgatcacatcctactcacatctctaaaaatctacccggatcaaaaaggggaaaataaaaaaaaaacctatgacttaggtctagagtaaaactaggagacagaacaataaactccaaataccaaagaagtggggaaatgagcagggtccagcaggagctacatcgaagagtggcttgtgcggaatcatactgattagggatcacccaaggccagaccccaccccctccaccacctgcccctcaacagagcactactgagtgtaggttagagcactggcaacagggtggttaaaggaaggactacagaaaagtacttgggtccagcaatggcaggctcaggaaggcaccatgcatgaaaggaaggggggtaccttcaaaagcagaagtgtcccttaagcggctgtaaaggggtggaagcagctaatgaaaaagagtcttcattaagctacatggagctgaaaaatcagaaagtggtgattctgcccttactaaagcaacagaagagggatcccttcaaccaagacccctaaagccacacaattcctccctgctccaccatgaggtctagtaataacaggtccagaaaaaagtaacatctgttatagaaacataaacaagaaaaacagaattcggaagtctaaataaagttattatgggaagagtctggcgaatgagaagcaaaactttccggtagacaaaagtagaccagaaaaattcagtcataaacaatgggaaactagtaacaccacattccaacacaaaaggagaatgcagcagcagacaagacagaccaccagtgatgagaaatacaaattcagaaagaaatgagcacatcttaaataaaaataagaatactaaaaaatactgaagaaatatgcaaggtaactttggaaataaaggctaattttattataaggtgaccaaagaagaagcagtatgactaaaatttctactgaggacagactctagaaaattaaaaaacaaagaaaatgaataaaataaacataactaaagaaatgcatatcaaagcataataacgaaaaagattaatagctaactacataaacataaaacctttcatttggcaaaaaaatcctataagcaaggttaaaagacaaatgacaaactgggaaaaaatatttgcgaatttaccagcgttaaaggactaatctccttaacatataaagtttctaaaagtgaagaaaacgaccagctgagcagcaaaatgagcaaaagactatataaaactataaacagctctacaagaaaaaatgtccattatcattcataattgaggtaagctcaaaaattgtaactatagtaaaataccatttctcaattggcaaataagtaaacatccacatttaacaacacattctgtttggaaagttttaagaaaagagatactgttgtaaactgctggtgggaatgcaaaatgttatttttctgtgaaggaggatttggcagtatctagcaaaattacacatgcatctaccatttgatgcaacaatcccacttctaacaatttatcttaatgatactttacatatgtacggaataatgcatgaacattaagaggattcactgtgacattagtactaacagcaaaaggttaaaaataacctcgatgcccataaatattgataagctatgctgcatccacacaaaggagcagtattcagtcatacaaaacaaaatggaaaacacctctgcaataatgtgggatgattctcaggatacactaggaagattattttcctagttctgtcctctgataaggcctacaagcagtaacgttcaaaagcaaaggccatactttgcatctaaaatctgacttctaaatgccattctccaacaatttattggaaaaataacttattccaggcctgagaatgaatgttcgagattagttagaaatctcaaaatctaatagggtcattttaaaagcacacgatagctaagcaatttgaatatcatttagagtaatgactgtgaaacgtattaaatacaaaaacattcattagttcgtaatattcaaaaaggcagcaaaaaccaaccaaaaaacaaaattaaattgtcactattaaaattattacattaactccttactctaaaaaccttaaatctattttatcatgccttttctgtagaactgtttttcaaggtaatcaaatggcacccaatgatgagaaaaaagaatgccaggtatatatgtaggacaagcagatggaaattttttttccccaaacagccattttgcaatccccaatgagataacagattaaggtaatgatactgataaatacgaaaatcaggtgaagggcaggtagcaggttctggaaagatgatgatggcaacgacatagttattattattattattttttgttttattccctcccaacctcccctacaaaaacagcaaactgaatgagaaaaccaaagacccagagacattatctacaacaaaaccatgaaccattgcatataattggacagaaacaaagctctgacaactacaagactggttagtaaggaagcagatgcaaggtaactgactgggtttctgacagccctgagaacactgccaacccactggaaagcacaggccaatctgaaaacagggcttaaagttttaaaaagttctacaggatctaatttgcagatgattacaaagggatcatgatgtagtaagctctgggcccttaaaacacccgaataccaaacccccaccagaaacaaaccttgtaccgaggaaaaacttctgggaataacttccgaatggaccaggtcagtaataaaaaccaaaaaaaagttcaaatatatgtgtgggatagaggagtaaagaaggcagtttcagaaagcacaagggcatatttttgaccattttacaaaaacacagacttctcctcgtccctaaaaagcgaaaaaagttatcctggcccatctctccctcgtccaagtatgagaaactcatttcactcacacacacacacacacacacacaaataaataaataacagaacagagtgaaacagtgtaattattagagaaaaagtatgtgcatatacatgagaatggtgtccctacagaaaatcaaagtacatgaaacaatatgcaaataaaacatgaaaactgtaaacaaatttcaaactgagctaaaaagaatttaaaaaataacaaatcattagaaatgggaaatttctgaatgagggtaactgaaaaaaaggaagacatgacacaactaaggagtaattagaaatgcaaggaaaaaaatcccatcaaatacaaagaaactaaaactaaactagaagaaacataaaggtgaataaaacagaacaataataccagaacctgaaggcagaagaaaaatcttaaaatcaaaaagaaacaaacccatgcttgagactctccttgctggtccagagccacagtgctgctgtgtactggcaggaggaattctgctataattggtcctggcagtgttcacctttcctgcaagtgttccacagcccagggacacaatgtggtcaggagcactgccaggaacaccagcaagggggagcctgccacaacaggcacaaggctcaggaagcactctccagcccacgaaaatctagtgggggtcctcttccctcacccaaacacactctgcgcagctcagcctggagaaggcccctcaagcagcactactaggaaccagtgcgagccccagtggactgagataaaagcaacaaaccaaaacagcaccataaagcctctgaaaaatggtcactggaaccacagctcacaaatatatgctagtacctacatgctataccttaacaggttactactgaagttaaaatttttaaaaagtacagagtctcctgatataataactaaaatgtccgagacacaatccaaaaattatctgtcataccaagaaccaggaaaattacatgaaggaaagaaaacgccaacactgggatgagtaagatgctgaaattatctggcaaggatcttaatgctgccatcagagaaatgatttgacaagcaattacaagttctactgtttcaaaaacgaaacaatagaaaatctcagcaaggaaacaagatacaaggaaaaaaaagcaaatggaaattatagacctaaaaaatacaataggagaaaaataatcattagatgggctcaacagtagagtgaagatgacaaaggagagaaatctgaacaaaagagagaaaatagactgaaaaatgaaccatgcctcaggtccatgtggaacagtaacaaatgactcaacatttgtatcattagaggcctagaatggagaaaagagtgacgctgaaagaacacctgaagaaataatggttgaaaattttccatgtttggcaaaagacacaaacttacagcttcaagaagctgagcgaaccccaaatagcacaaataaaactattctttgggaataaagggaaaataaagtcatcttcagaaagagaaaaacaaaaagaatttctcactagcagaactgcctttgaagactggctaatggaagtaataaaagatggaatcttggaaaaaataatggaaatagcagaaacatgggtacatacaacagagcatcactcccttgataagttctataagtcatattggataactgatacaaaaactgtaatagcattaatcctcaaaacaatactatttaaaagtggggaaagagacccaactgaaattaaggtttccatatctcattccatgtaatggtattgatggcagtgaatggtggtaagtcacattatctataatgtgatacccacaatgaccgtgaaaacaactataaaaaacacatagaaggccaggcatggtggctcatgcctgtaattccagcactttgggaggctgaggtggacagatcacaaggtcaagagttcgagaccagcctggccaatatggtgaaacctcatctctaataaaaatacaaaaattagccaggtgtggtggcatgtgcctgtagtcccagctacccaggaggctgaggcgggaggattgcttgaacctgggaagccgatgttgcagtgagctgagattgtgccactgcactccagcctgggcaacagagcgagactgtgtctcgaaacaaaaacaaacaaacaaacaaaacaaaacccaaacactaaataaatcaagggtcttaaaaatcttaaaaaatgttcaagtaatcatggaaggcaataaataaataaccataaacagaagacagaaacagaaaacaaataataaaatggcagacctctccctaacatatcaataattaccttaaatataaatggtctaaataaaaaaattaaaaggcagagactaacagtttttattaaaatgacaactatatgctgtttacaagagattcgtttcaaattcagcaacacaggatgaaagtaaaatgatagtaaaagacagatcatgcaaacattaatttaaaaaaaaacaaatggttacactcatatcagattcagagcaaagaaaatcgcaaaacagaaaaaacttatataatgataaaggaccaatcaccaagacatagtaattctaaatgggtatgaaccaaatgatagagcctcaaaataaatgaaacaaaacctgataaacagataaatctcagaagcagacctatataaatattctcaagtgatttttaacgtatgtgaaaaaaacaattcaatgaaggaagaacatacctagaaaatacataaggaacccttaaaactcaacagtaaaaaaccaaatggactcttggtttttaatcccagagaaatacaaactttttgtttacaagtaacatcacagttaatggtaaatattatagtctctctcaataaaatgaggaataaagtaagaataccttctaccaaaggttctagccagtgcaatagaggaacagtaataaataacataaacattggaaagaaagaaacctgtcttgatttgtagatgacatagctgtttactagaaaaccctatgaaatctactaaataactactagaataagtcaatttagaaaggttataggatataagatcaatatataaaaatcgattttatttcaagatagtaataaacaagtgaaaagcagtatttaaaaaataccactaatagcattagaaacatattttaagtttattcctaaccaaagagtacatgatttcaacattaaaaactataaaacagtgctgagataaactaacaaacatctaaataaatggagagacgtacggtgttcaaggattggaagaatatattgttaaaatgtgaattctctccaaattgacctgccccagtcaaggcaacccaaatcaaaatctctgcaggctttgcccttttgtttgtaaaaattaactgattctaatatttatatgcaaataaaagtcaaagcaacctaatgaaaaagttgtgggactcacagcatctgatttgaagctgcagtaaccataacagtgtcattttggcaaaaggacaaaacaaattaatagaacagaatggagaatccagaaacacggctcacacacagattgattttcaacaaaggtgcaaaggcaattcaatggggaaagaaaagtctctttaacaaatggtactggaacaaataaataaaactatttagaaaatgaatgacatccactgtctaacagcatcacaaaattttattggtggtggatcacagatttacacataaaagttaaacctatattacacaattagaagaaaacataagatatttgtggctttgggctaggcaaagatataaaaggacataaaaaaccataaaagaaaaaataaattagacctcaaaaaatgaataatttctgctcaccagaagacacttaagaaaatgaaaacttggagaaaataatcataaactacttatcagaaatgggccttttatatagaatatacagtattccccacttacccatggggaatacgttccaagacctccagtgatgtctgaaattgcaaatagtactgaaccctgtatatactatgcatgatttatttttccttcttcacaatttcatagatacaatactcatttttaccatagattttagcaacctcaacatatgatttttaaattctttccttaaaggaagcactttccagcttctctttggcatatatattcgaatttccaacatcactgctcttgtgctttagggccattattaagtaaaataagggttacttgaacacaagcatgtgatactgcaacagtcgatctgataaccagtagactaaaagtggtgggtagtctagacaacaacgatatactggaaaaagggataattcatgccctgggtggaaaggtgggagatttcaccatgttactcagaatagcatgtaatttaaaacttaagagttgttggctgggtgcagtggctcacgcctgtaatcccagcactttggaaggctgaagtggaagaattgctagagtccaggggtttgaaaccagcctgggcaacatagtgagaccctgtttctacaaaaaaataaccaactaaaaattagctgcacacctgtagtaccagctactcagagggctgacgtaagaagattgcatgagcccagatactcagaggactgaggtaagaagattgcatgagcccaggagtttcagtttataacaatctgtagtcatgctactgcactccagcctggatgacagagactttgtctctttaaaaaaaaaaaaaccaacgaaccaaccaaccaactctccctgccctgcacccgccaacacacacatacatcaaaaaccctgaattattcatggaattttctacttaataaatatttttggaccactgctgaccaaagataactgaaaccaaaaaaaagcaaaactaaggataagacatactgctatattttaagaaaatatctatagtcaatagaaatacaaaaatccaatattaaaaatgaggaaaagacacttttagttaaatatgcacctgctatatgctttggaaactccactcctacatgtttgcccaggagaaataaaacatttccacaataagactacacagctttattcacaatagtcccaaactggaaacaatccaactgtccaccaacaggtaaaaaaaaaacactttgcgtattcatataatgcaacactactctataattttttaaaaggcactataaatcaatgcaataacatggatgaatctaaagagtcttcatgcagtacaagtacataagattccattcataagaaattctagagcagacaaaagtaagctacagtgacagtaattaggacagttattgtctgttctaatgggggatggagattcactggaagggaaaacatgggaactctgtgctgatggacatagtctacaccttgactgaaatatggttacataaatgtaatttttaaaaactaacccaattaagccctgggtatttcactgtattcaaattttaccccacacaacatcgacaccaccattattaccaccacattgataacattcagagagcagttagggaatcacattattttgaaaattagtaagtaatgggaaagaattaagcattatcgtatatgatatgtacatatttatatacatgtatacagatcctatatgtggatctgtaatttagggtagtcatagagttgatgagaaagagtttttcttaagaagtattacaggtaataaaggaaggaggaataaagaattcgagtatcacaattttgtaaccctcaatgaattagcagatctaggcaatcagaatccacgataaaaattactagaaaagacagaaagcgagtgagacttttaagttattcctacaaaccaacatctatgaagtatttgggaaggaaataaactctgaatctgtttttcgtttttttgagatggaatctcactctgttgcccaggctggagtgcagtggcacgatctaggctcactgcaacctccgcctcccaggttcaagcgattctcctgcctcagcctcccgaggagctgggattacagctgcctgccaccaaacccagctaatttttgtatttttagtagagacggggtttcccccatgtttgccaggctggtctcaaactcctggcttccggtgatctgcccgcctcgggcgtttttgcatgtattttttcaggtgctgaaaaagctctccctgatttcatttcttgttgactgcttagagacatctttccaaatgtccttccttgtcactttttcaaagttaggagcagggattgcacgtttttttgattggtaatttttgtttcaaaggtttgattcagattcagagttgattttgctaggtatggtggctcacgcctgtaatcccagcactttgggaggccgaggcgggcggatcaccagaggtcaggagtttgagaccagcctggccaacatggcaaaacccttatctctactaaaaatacaaacattagccaggtgtagtggtgtgcacctgtaaccccagctactcaggaggctgaggcaggagaatcacttgaacccaggaagcggaggttgcagtgaactgagactgcgccactgcactccagcctcagtgacagagcaagactgtttaaacaaacaaacaaaaaattaacaaaatcttatttctagtggtttacatattaatgatgctggcaacttttagttgaaatgtattaaacagcctcgcagtttttatttttatgaattctgcatacaataaataaataccaaccaaaatatctatacaggcataccccagagatactgccggttcagtttcagaccatggcaaataaagtgattatggcagtaaagtgagtcacacaaatttttttgtttcccagtgcttataaaagttacgtttacattatactgtagtcaagtgtgtaacagcattgtctaaaaataagtacattatcttaatttaaaatcattgctaaaaatgctaatgaagtgagcacattttgttggaaaaatggtgctggtagacctgcttgatgcagggttgccaccaaaaaaactcagtatctgcaaagtgcaataaagtgagatacgcctgtaatgtcttttttctcttctgttattacaagcactactttaagtcttcaactaccgaatacttgtagactatttaatgaattaatattttcatcatatttatattgagaaaattaagaagctgaatttagttagaaaaggtttagaatatcatcaactcttgaggatgagttggaagctactttatctgtcatttttcacataacactagtttgcccttcaaatcatacatttaaaaatgatcttaagatacataccaagtagggattatgttgttataaaaagctagaagtaaaattaagactttaatttcaaagataatttctctataaagaatagcacaagatatgttcaactattctcagagatgcatcaagatatgactttttttcctactagaaattatatctatgatcaatcatattacagagatattgctgttatactccttgtgactgatgaggggggtttttcctatcaccatgttatcccaaccctttaatgaatcacctttgaaactcagaacaggtagcagcacagaggttgctaagagtaaatacattcaccactgctgccagaaatgaccaacggtgcaccagaaagaagaaatactggtgaattcccacataccacgacgaacaaccttataaaataacagaacaaatgaatataaagtaacatacagccatcccttggtatatgtgacagggattggttccaggaccacgtgtgtataccaaaatccatgcacgctcaagttctgcagttggccctgtgaaactggcatgtatgaaagtcagccctctgtatatgcaggttctgagtcccaccaatactgaatctgctcttagttgagaaaaaaaatctgcatgtcagagggcccatgaagttcacagctgtgttgttcaagggtcaactgtaatataaaaataacatttattgctagatagagttgatattcattctagtgtttatatacttgagtcttagagcaatagcctttggagacaacttccaggaaggtacgtgtttgcatgccttctcactgcaatccatcagtagctgccacttgaaccagtcttagcaggggatggggaagcctatgtctttcagaattggatgatgtagtacacagaagtagacagtagagtagtaagggcatttgcttaaaagcagatagaactgggaacctctacatctttctgtgagaattcagggcttagttttttagggtgtaaaatggaaatactagtatgtatctggacatattatcttaagaattaaataaaagactaccatttcactcaaaaagtgcttgatcctgggaagccatgtaacagttcacaaatgcagagttcaaaagaaaggaaaaattgcagacatggtagccttattttaattatcttctaaccagcagtaagcatactctaaccagtgaggaatactagataatccatacgccaaatgcaggagattacatgagacttatatataacaacacttcattcatgaaataaatcacaagattagctctgaaaaatggtgattatattacaaatacaaatctaagtatatagatgacaatttgtgagtttgcttatttgggaattagtacctagagataaaggtctgaagcaaaatcacacacccctttggtgaatcaaatcttcctctgaagaactaagtacctcacctaatcagaacagagtccctggtatagccaccgtcatattctgtagtttcttctagtgcttggaaatctagattctgcaaattcaagaaaatatgtcttagttatctgctatactactgtatcattacaaacaataaatcgatacatgactttttgcagacacctgctttcttacccggcttccacatataagcaattcaatttcttctggtctgaataagtactttaagggagattcattggtcaccatatgaaaacctctccgaaaagccttgaactgtttttctactgatttattgagaatgtagtcagaataaagattgacaaattcctgtagaaaacattaatcacaagaacttcttataatatgctatgcaaacaaaacacaagttattgggctgcatagctttttaatttttccaagaaaaaaacattcaagaatattcttaaaaattcaattttacacctacttcttaacaatttcacaattctctgttatagccaatattaagctatgaaaaggccatatacataaaactgtcaagaatattcttaaaaattcaattttacacctacaaagaaaactacttcttacaatttcacaattctctgttacagccaatattaagctatgaaaaggccatatacacaaaactgtcatacttataaatgtcaatttcgataatgtattaaacagaactgaatataaatgctggagacgcagaaaattctttaggttctctcaactaggtatgtaaacagacacatttaaaccatgtatccatctatttataaatgccaaccgttttaagagagtacaatatatttgatttaagcaaaccaggaagtcccaagttttctaccatagaatatttggtaagctgcctactgtatccagttcagcaaaaatgtggaagtactgactgacacataaactactgtatcaaatcataaaaggaaaatgtgctttgtacccttagtgtgtataatatttaatcaaaaaattatatcaatataaacatgtttcttaaaggtatactatatatttgtcataattttttgcttgttatgttctgggttattcccattcccgatgaacacattttagtcaatagaaacccaaatctgacgtaaagtatacttttcagaaatgtatttttatcacaaacaggatatacatgtgtaaattaaatgtaatttttatttgttctgtgataaagaccttaatcatgaggttcctgcttacagcttaatacaagaaacaccctgcttcttgctttatactacaaccacacttagctattaactatctcctgcttcatgtcctctttctctaaaaggggctttagtgcccaactgtgtgctttcataccaacttatatccaagatttagaaaagtggactctagcatttacataaacttagttacttgttttttttttgtacagactatattagatacttctttaaaaattataagcatacatgctttgaaagtgttaatgaagagacaaaatgtgacataaaaacatttattaccttcctgttttcatttgtaattggaattttatcaccattttcctttagatcatacatcattgggttaccaaaaagatctgtctgtgatatctggaaagtgatcatcatgtcatcttccacattcccttcatactccaataaatcttttaaactctgatatagaacctagcaaccagaaatggtaaattgaggccaccatagaactacaaaatacaacaaataatttatatcactcttcttagaagacaacaaaaatcttatcaataaaaattgtaaaaagtgtagacagtatccctccagtcccccaaatagtttccaacctataaaagaaagattgtcagtcactgtgatgtcccattctctgctgagaaaccccataccaccaatttagcaatagaattcacactgtgctctatgagaaattctgtggtgtctcaaggtgggggtgggggtggtaggagcaggcacactcgttgtaactaccaagacccttagccagggctactctgatttttacctatctcttaagatttcactaaaacacaaacaaaatgtttagaaacacttctctatgaaatcaatcttacaaaagcttcgtgctgacagcaatatataaaaatgtccccctttgagtttttaagtgtttctggtacttcggtcagattaaaacatttttatcttattgataagagtatcaacaaagattctaaacaaaaactttaaaattttgacataaattaaatttttgcatttaaataaaatctaagagactgaattaaaaaaatgacaaagaacttactgggtgagagtctcccaagtcacgaaaagttccttttttccccattagcttcctgtagacaaccatgggaaaatgtacatccagtatacagttattgtaaatagccagacccagtactatgccaatcagagtaaactgaccctcagtttcaaaagaagatggattaaaccaaaacaattttgtagattcatcgtatgtgaacatacctataagaaatgatttttaaaaatacattacttttgtattttattaaggactgatgaataatacaaatataaacttaaaataattatgcatataaaacatttaaaatatatgtaattaggcatgcaacattgatttctattatattagcacttgagaaaacaatgtccacatatatctgctataaattggggtgaatggtgatatgtaattttatgaagccaaaggaataaagtagtaagtaatttggtggcatcgggtagaaaaatacgttaattaaattcaagctttctaattttctactaacacataagaaaagttatattcatgctttatccacccatagctgaaaaataaacataaaaaaacaaaaaatggctacatttccaaagtgtttcatttataaaaatataattacttatatctgtaccacacgtactatttttgaaaacaatttttcatttttttccttgagatggagtctcgctctgttacccagggtgggctggagtggcacgatctcagctcactgcaacctctgcctcctaggttcaaacaattctcctgcctcagcctcctgagtagctaggactacaggtgtgcaccaccacgccagctaatttttgtatttttagtagagaaggggtttcaccatgtttgccaggatggtctcaacctcttgacctcgtgatctgccagcctcagcctcccaaagtgctgggattacaggcgtgagccaccacacctggcctaaaaaacaatttttaatcacagtaaagaaaggttcgttttttcaaaattagacaatggtgccatgaaatttttctagcattttcctaataaaatcagatgatctgaaatacataaacctggataaatctgatgaacttagataaacaaagctattcaatacacatgttaattatgggccaatacgtaaaagaaaagtagtttcgtagtctttcaatttcacatggtcttcactatgcaagccccaatcatggaggcttttttttttttttttttttttgagacggtctcgctctgtcgcccaagctggagtgcagcagcactcagcttagtgcaagctccgcctcccgggttcatgccattctctggcctcagcctccggagtagttgggactacaggcgcctgcgtggaggccttttttatatcactcattggaaaattggggcccggtgtggtagttcacacctgtaatcccagcactttggggaggctgaggcaggcagatcacttgagctcaggagttcaagaccagcctgggcaagatggagaaaccccatctctacaaaaacacaaaaaataagctgggtgtggtagcatgtgcctatagtctcagctacttgagagggtgatgcatggggatggtttgagtcttcagcctgggaggtggaggttgcagtgagccgagacagaaccactacactccagcctgggcctcagagccagatcctgcctccctccaccaaaaaataaaagattaaaaaaaaggaaaattggaatctttggaatgagtactactaaaaattgatttcttcccttttaaatgactaaggaaaaaaattttaattgaatttaaatcattttactacatgtttagttgctactgtgaaacaatgaaaacatcttaagaattaagtctgaaaaaaatctgtaatttccaatagaaaagtagagcttagaaatcagaaatcaaattatacagtatataagtattttaacctgtttataagaattttaaaatctttgaaaatgtcattgtcactttaagtttaaaaataaggagctttaacatgtttccttgatcactaggagtatgaattaagcttaggacattttctgaatgcaaaatggtttgaaaattaaacaattcatatttgagtttcatggtttctatctaaacattttttttacaggccaagttacaacatccatggaaatgcttttagttataagtatggtattaacaggatcaagaacagctgacaaataattacaattaataaatttgttcaagctgacaatggtgtgtctaaaaaattaatgaatttaataaaatgtcacaaatgcccttccttggaaccaagagcaacaagctataagttaatcagaatataactctgaagttccattttaggcacattttctcatgttccagggagaaaagcaccataacctcctggtaaaatactcctttttgatacttctactgccatcacttcagttatcttactggaactgcttaatctatgttttttcttacaagtatttctgcatataatgcaagtatgctttatagctaaggtttaacatttctagatacatcaaaagctagagctaaggtttaccaaatttaagaactttatgaagtttataattttctatctcaaaaagggcgtcgtcttatgtatctctgatttacttagaacaaactacatacaaatggcatagctttttagttattaataaaacactagctagattatagataagggatgcgtgtgtgtgtgtgtgtgtgtgtgtgtgtgtgtgtgtgtgtgtgtgactaagaacagtaacagaaaggtcaactcaattagaatcaacaggctataacagctcaaatctcaaagctgaagggaaatgacatacattattctatgcacactcctcacaattctgatggtaccttcagtggaaaccttttcctgtaattgtcatgtactcaattttaaacgtaagcaagctcagttactaagtggttatatttacagtagaaactgaaccagttcagaattatgaagttaagtagactacccaaaagactgcatcttttccctgttctactttatcacaaaagggaaaaaactaaaattctgatccttcactttcaaatttccaaatcccatcagcctttcccaaactgtgttcaataacaactcttctgttagggcagaaaaagagttctggagttcaaaaagtttgggggaaacactacctatattaagccccaagaaatcttatagcaaataaacctaattaatgtgatatcagctagtgtttctgaactttgagcatgacatacttgtgagacagtctctcaatactcttcaaaccattgttctttgaagttcacaggtcaggaaaaccgtgagtttgatgatggttttagacaacaaaaagcaaagaaatccctccaactgttccaatataccattctaaagtgctttcaattcagtttaccaaagagataatttccttcattagaatattccttctaagaaataaaagaatttgaataaattagtgatacaaatcagttcctaaaacctacaaattcagtcatgatgtgtgattctgggtaatccataccaaatccttcttttgctgctcttcatagctgaaaatatttacaaagtaagataaacaaataactaactcaaaagatgatacgacaccataatcacattactaatgtatttaccaatatctggattgaagatttcctccacaaccagctgaaaaaattctttggaaacacctccctcatcaactccttgttctccttcaaattccacatacaactgcttcttcaagtctgcaggattttccatagcgatcatctctagctagtgattgaaaagataaacatgaaaagaagatgattgctagtatcaggaaaaaaacaaaataaaaacaaggagtaggattaggaaacaaatacaaatttttgactttttgtatgtaaatggaaacagaaagcaaactgataaaaagccagtgaagacaaagattcagtcttaaagataatcaaaaagacagacacaaaacagacactagcatagtaaaaagctaactttactgatttgttatgaaattaacatacaattaattaagattttattacttgtgtgttaagtctggactacacaggacatggaaaagcagctaaatcatttcagcaaaaacaatggagtagaggtctaacctcaaaattgttcattagtagtcctttattagaatagaaactcaagggttaagtcttagtatctactaagtcataagtaaaatatttcaattaagaaaaatacactgaatactaaagcagtttatggtctctcacagtaagacttagtataaattaccaccttttaatggactagaacccatcttatatccacatttccttaaaaacaggtgagacataaccttactcatgtccttactctttttttttttttttttgacatgaaatctcactctgtcgcctaggctggagtgcagtggcgcgatctcagctcactgcaacctccgcctcctgggttcaagcaattctcctgcctcagcctcctgagtagctgggattacaggcaggcgccactacgcctggctaaattttttatttttagtagagatggggtttcactacgtttgccaggatggtcttgaactcctgacctcatgatccgcccacctcagcctctcaaagtgctgggattacaggcgtgagcaactgcacccagcccttattcttaaattgtaagttaacaaactttagtgtctagcattttctcaactataaatcttttaccaaatatttttgtgtacctatagaattatgaatatacagtaacctcattgagattaatcataaaatcaacactagattccaatattaactgtttatactgcattttgtttgttttactttatgtatctaaaatttgctaacagtatgactgtatccagtacatggatggatactgtatctagtacatggatggatactgtatccagtatccatcatatctcctaacttgccttcaaacatctgttggctggttaaaaaaatttaatcttggagatgaaaatttaccaaaacaggatattaaatgttttcaggttattccaactatttcaaacagaattttaaaaatggttttgaaaaatgcaataatcactgaaacaactgtaacacagcactatagtagttaaagtaataatactcatttggacaatctagtctgtctacaaaaaataaaatctcataaattaacgcatcaggtcaggttgcccgagagcattgttttttcaaacttgtcacctgcaactcattagtgggtagtctaatccatttagtggtttgcaatcagcaatgggaaaatcagaatgcattccacatagtaatggaacctactgttttgtgaaacttttgtttcaattagatgtacagatggataagcatgtactgggatgctatgtaaaatactagggattgcagtcaaagagtttgacaaaactagctgaaattatcttctgggtatcttcaactttagggtcctattctgtgaatttagtctttagctttaaataatgtctgttgttgttcaacaccgatctctaatatttacaaaatcatttttaggccacacagtttacttttagacaatgttttgttatggaaagaccaagagtcagtcagaattcaccttactagtcccaactctcacttaccataacttttaacctttaaactttagcacgcgattcaattaagcctcagtttcctcaacatactgtaagttgtgaaggcttattaagaatatatgagaacgagtgttaccttttaaaatagttttgctctctgaacaacagatttgcaattttgtgtccccaaaggaacttgatatagactagttccaagatctagagtcaaacaaatgtagatgtgaaaataaccttggggaaaaaaatagtttcagttggaaacctgtttcaagctacggagtatacagaattctgaggagactaaaattagaattaacatcttagctcaaatgtgggaccaggccaacattccatattgccatgtaatccattctgagtttccttatgccagttcccaactggctaggtgttaaagatgtaagtcagtgtttatatttacctttacatccaaaggtatacttgcttttatcaaatataatgtattccaaagtggggaaaaaaaaggttatctggtatttagactgtgcattctacagcttttccccactaacattcatagatgagagctgactccttatcaatgtaaaaccttttaaaggatgtggtggtgaatttctacaggattgagaggccctgtgttctatctagtcttagctctacctaagacatgtcaaatgataactgaagcaaatttatctttattctccataaaatattacatgtctgtccacttccactgatctctattctatgctccccaccttggtgccaaaagaatgtaatgcaatgcaatatgttctattgtaaatgcaaacatacaactttacctctcttatttcatctgtaaaataaccataataatatagtaataaattaatgtatgaactgcttagattaattccctgcataaagttagtgcttaaaagtactagctgttgttgctgttattttattggttctaaaatattttctgaaaacctaccatagcattatagaacaaaaatattccatgaatacagcaacaataatatatagcacttttgtagcatttcacacatagcaactaatttaatcttcacaacacccttatgaggaaggaaacattaactccactttacagataaggaccccaagatactgaaaggtgaaataacttcaagtcacagtaagtcacagtaagttgtggaacagagatactaatccaggaaacaagctcttaactactatgctttactcactctcttcaatgacgaccaaaaattttttttttaggattatgagtgatttttattttccttattcttttccatatttttccattttttacaacaaatacatttttcagagtcagaatgtgttcaaatataaatatgtaaaaagaataatttgaaaagtagttggtaactgaattctgtaggcaaaaattttgttattacctattttagattaccattctggtacacataagtgatttcataaaatactgtaccacttaagaataaaggctgggcgccgtggctcacacctgtaatcccaccactttgggaggccaatgcaggcagattgcctgagcccagcagtttgagatcagcctgggcaacatgatgaaaccttgtttctacaaaaaactaataaataaataaataaataaataaataaataaataaaaaatagtggggggtggtggcatgcgcctgtcatcccagctacttgggaggctgaggtgggaggtcaaggctgcagtcagtagagatcgtgccactgtactccaggcctgggtgacagagttaagaccctgtctcaaaaattaaaataaataaaatagtaaaaacagaatacataaatagcctttaaaactattttattttaaattattaacacataaaatttagcaataaccattttgataaaggccattattgcataaacagctgtactgataattctttttcttaaaaataacctccatcaattgttcggtcaatttaaaaaagatttaacaaataaactgtaaaggtgtattctttacataatagctatattatttaaaattgtatgttgttgtttaaacccaaacctcaccataaaactgtattttttaagtcagaagttgttttaaatgcattaggatatttgaaatttggaggactatgtctaaacattctgaaaaggagaacgtgcatgcatgcctgaatttatttacaatacacacgtggatttttagggttttttttgtttgttttttttttttttttgagacggagtctcgctctgtcgcccaggctggagtgcagtggcgcaatcttggcgcactgcaagccccgcctcccaggttcatgccattctcctgcctcagcctcccgagtagctgggactacaggcgcctgccaccgcgcctggctatttttttttgtattttttagtagagatggggtttcactgtgttagccaggatggtttcggtctcctgaccttgtgatctgcccgccttggcctcccaaagtgctgggattacaggtgtgagccaccgcgccaggccaatttttaggtatatttaaaagtacagtgtatgttgtatttatttaacatggagactagcaacagacagagattactggggaaaaataaacaaaaatatcctggatataatcatatctacctcttcactgcgtaacttcctcttctttaagactcttgatttcatcaattgctggataaaatgatttttaatttctgaactttttaattggccatgatgatgaaatcctagggagttcattttttaaaaaaaaaatctgacctgatatcaaagcatttgcagaatacctagcaggatgacatcttaatatcaaaatatgatattactagacttacaggaatcaaaaggaaaaccttatcacttaaaatcttatagttttctgagctattacatcaaatcaattcataattttttaaaaaaattccttaataccatgaatatttaagtagaagcaataatcagataaaagagacctctaatacttaagaatgcctgggatttctaagaaaggctagcttcaaggccgggcgtggtggctcatgcctgtaatcccggcactctgggaggccgaggcgggcggatcacgaggtcaggagattgagaccatcctggctaacacggtgaaccccatctctactaaaaatacaaaaaaattagctgggcatggtggcaggcgcctgtagtcccagctactcgggaggctgaggcaggagaatggcatgaacctgggaggcggggcttgcagtgagccaagattgcgccactgcactccagcctgggtgacagagcaagactccgtctaaaaaaaaaaaaaaaaaaagaggaaaaagaaagaaaggctagcttcaactacttcagtcaacttgaggcttaaactattgcttgagatttccagattatccaaattaattttttcatgttcacgataaacacatgaagaaaagtctgttatatctcaaatgtagtttaaatgtttgggtaacaccaaatcacataatcacgttcgtccatgagacctggaatcctgacttctatttccaattctgccattaatttatgtaggctggaatctcttttagatttcattttcctcacatgtaatactaagtttgatgtttcattgtcttaaattattatataatgctgaggatctatgtatatataggcttcattctctcattcagtttctgagaaattactttgagggcataaaccaagcatatttcttggtttcatttttgatttcaattagaataaatcacaagaaagaacaatggaaattacatgttaaccacaatatagtgtatgtgtaagacaaaattaaacatacctagtgcagcacagaataatctcatttttaaagctctgtgagtcaatgaataaataaaagaattacgttcatgtttcactagtaagagtgttcaccaatgctggaagctgggagctgaaaatgctggaagctgggttagactaggctattagaaaccagataaaaagggccagtgacttttagaggggattttgcagaacctcctggtagtggggctttttatctgtgccaatcacctttatctgtgctaattcctatttttgaacttccctattcaattccacatctcagccattccttttggtttttagatatttatgtgaaatgctagaactccctgactaattggaaccaagtttcacatcatcatcatcctctattccaagcttgctgtccccatgatcctcttaaaaatctgagtttccaaaacacataaacatacttgtatatcaaaatggcctttctctttctctctatatatgcacacatacacacataaacacacatgcacacacacccccacctgagctgaaccaaaggccatcttcccaaatattggagtctggctttatcaaaatatttgtggagtattaccagaagttcagattcataggctctacaatacagcttctaatctaaacctctagaggttagggccctggattttatttatttatttatttattttttttaaacaattttcccattcagatgtgaaggcagtttgagggacctcatgatggcaatactatattcttccataaacttataacctctatcttctcctttaagaagtaatttaaaaaatcttaatacatactatcattggaagtgcttcatctaagaaaaatgagaaattatctacttgtaaaagaacacacaaatgggtatatttacatatttgtaaatatgtaaatatttacatatttgtaaatatgtaaatatttacatatttgtaaatatgtaaatatttgcatatttgtaaatatgtaaatatttacatatttaaattaaattaatttacatattaaattaaattacatatttatattaaaaatgtaaatttgtaaatatggttttacatatttgtaaaaacctcatcacattaggaatgtcattcaaatgaaaggtgaagtctaagctcatgtttatcactgtactgttttctaaggaacaataacgaaaaaatactgaaaataagtcctaggggaactatggcagtaagttaaacgggtagggtgggggtgttcttaagcagttctaaggtatttgtgaagagacaacttatattctattgattctaaaattcacttttttcacattatctctgaaatcagattacaccatacaaatgatagcatcttacaatgaattgctggtatttttctgtcttagcagtaataaaatgatagtgtttcctacaatcagagattagtgaaaatactatcaacatgaattcttctcttgtcatcaaagacaatttctctaaaaacctcaggaaaaaagctgctagtctggtttgaatttcacaatatataaaagcaatgaatatatttttcttttttaaaaaaatccacaattattaattcaagttaccactcctcaacagaaaacatacaagagtctcatatatgaagtcactattttctgggcttgatttctaaactaaggagtggataactctaaggtttcttttagctcttaaagcctaggatcccataattttatttatcaatattaagcttaccacaaagtttctcatttcttcttttccacccaaccctgctatacaattccaaaattagcaagtcataaaaaagtggccactagtttgttcactgtgatatataagaatgaggcttaaaaagcagagatccttgggaaataagatcttgaaaaattcatcacttttgagctttcatatgagagaataatcttaaaccactttctattatagaacttctactatgtgttactaaaatatgtggctttatcataatcatcacctgctgtgaatacttacttcaaaaaattacacaggttatcaattttacttataagacctatttcgatgctggtttttctagtcttttcacattctgttatttttttaaaaaaaagaaaaggaagaaaaagcaagggagaaagaaagttaagagtaaaatctgcttagtgtgagcattcagagcccctaaggaagcttctctgtaagcatcatctctttctattttcacagtttattaaactgcctaacacacatgatttctgaagtgaactgcttttgtgggctggcaatattcaagtacatatactatctagtgaatcctgatttatgataggccacactatattatctaattttgatataattaagcagaacttgctaaaaacaagttaccataattaaagagctcacagttaattttacactaacacctaaggctttaaaagcagttgtttccttaaaattctagaatagaatttaaaatatagaataaagtatataccaagtacttaaacttttgtttttagtcttgctttactagagaaaaaaatgggggactgaggaaaataagactgagtagacttctgagcgaaagacagataaggaaggtagacaattttttgaaccctggaatgattcttacagtgtaatttcattgccttttaaaggctagacatagcttttgatgaagacagctgaagggatctcacctcaagaagccaaacataaagtatgtagctttggcatttgcagttctgctccaacaatggatagtcatagacagacctcaacatacctttcataaaacatcactcacattcttataaaataccctatcattctgctaaactatgtaaagtaaggtgctggctgccttatgatcagtcattaagtgtattaattattcatgtgtctcaaaactatgtaagtgaaataaaaagggtaccagaaagcaagcaataataatgacttcaggcagttaaagcccccttttgtctctgctagaaaaccacctgagttgcttaaataatgcagaatctttctccaacactataaacatatctgacattaaaaaaaaaaaacaaaccagtaacaaaaaaaaaaaaaacacacaaaatctctgcaatttttaatttctgagatgtcaaataactttttccaccgggctacagctttatgaattctcgaatttagacaattctaaaactaaaatttagacattctaaaactaaaatacattttaaagtaaaaatcacatttcctagttgtctgtgtcagacaactttactagtatactatagtattattaactaccttaatttttgttgacattaaattttacttgaagatgataaaaaagtagcagcaatgacagggatagctaatactagaaatacaataaagctctgcgataatgcacctgagacaaatgtaaattttggtgaaatgtgactgacgactgctttctgtcttctggccactcttatattcttaaacagatacactaaaattatcttgtggaggaaagaaaaggaacaaatggcaaccccatctggaaaaccaggaagttaggatgagtacctgagtttccagtatttccctgctcaatctccctggacttgatgttacaggcaccactaatccccagatttttggaatagctgctgttttccagaagttccaagacccagagttgtctctatgaatttttaagtgggaagaaactaccacagccaggcagtgccgtccacacagggatattctaagtggcccagcaggactcaactcttactggcaacaggcactgatctgccatggtcacttcatcaagtccacaataatgcaactctgaattttacacgatggaattttttggacactacctataattttatggtatggttttactgtaccattactcccagttcaagactgcacatccacacttattattgggtatctccacatttctcttgttctggtctttgtccaacactctattctcttctgaatgaaagaaactttggatttagttttcaagatttagaaaacccattctttttcaaagatagcatgaccattatataatacaaccgatactttgtagaacacatctataaacttgcacaggaacaacaaaagtataatacttatataagatcagaaatgtccatgtgttcctatgctatatggtatcatttttttcagtcacttttaaaatgaattcactgaactgtatcatgatatccccattattaggtttttaatctagcagcccaacttacccggacaagtgcatcatctatgatatggtcacgtctaactttgagtctcaaatatggattcaactgctgtccttgaactaagctgtagagaacagtgattcttcgttcactgtacatgcgaattctattgtcataatataatcccaaattctttgtgacagcattcaatataaagggacatgtcataaaagagaatttgttctctgtttctactttgaaaaaagtataatctttatccatttctagaacctcattcagtggttcattaataaactcttcaaaagggataagtggttttcgacaatccagggttttaacaccaagttcagtttccagggggtccactcgaggacctttcttgtttcttctttcttctcccaaaagttcctgaagtgtcagctcgctggactcagggatgggctcttcatcatcttcttcattgtgatttgtgtccacttcccctcccactacatttgcatagtaaaccattttcaagcacttcgaagcagcaacaatggcatcatcatcattcactagatttcgactgttaaattcattgcttatgactttataagtaataagttgctgaaatgtctccatcattctccgaatctggtctgcattgtatttagaccacagtctgatcagttttccttgggctgcaaggggtagcttgctcatcgctttgcaaaataatggcaaagccatttccagatattcaggactgtggagatttctattctccattacgataatgaacaaattcagataattaggatctcgagagtatacattgtgatacgtcaagtcacattccacgttaggtgacaaatatacaagtgcattgagaaaggcagtttcaattttttcattagagagcaatctggtgtagacccttctaatggcatcaatatccacagacacatcatcagggcctaatttttgcaaattgttgtctccctgtgagctatcacctatccttgaggaagatgcttctgagtcttcttccatagcagcagcagaacatgcagctttttccttttcatcttcatctttgtcttcatcttttgcttgaagagatttcagttcttccttggtgtgttgtttaactttccggaagctctgtaccaatgcctcagcactagaaaaaactcttccaataacacggattaaaggggaataatcctctctttctctacataattcaagaatttcatataccttctcttctgttaagtaagtcacatctagaaaatcagaggaaaaaagagaacatttattttcataatatgtatgtttactctgttgcaaaaagttctaaaagtaaaacagccaaacattctaggctcaatatcatttatgatatacaactcttaaagtatctaatacttagattcagcaaacaaaatttaatgcttacctatttttttcaatgaactacctacctataccaatgacctcacccatgcttttacattctttcaacaatgtataactcttaataagatcatgagtttaaactttctttataatcaagatatctattaatgtatagctttaattataaatatgaaccaatatgtcatgtactgattaatcataatacagctcttaaaacctcactgtagaacacacagaaatactactaatctgtgagttttcttgtttcagtactctgttctccaaagactaagaaggcaaggtcttaaaaaaaggctccttcagcatctatgtatgtattaaaatcaaactggttcattttgggtcttcctagtttgttccagggtagtcattctgtgagtgattgagaagaatataccatttctcatcggctcttaagtagaaactgctttccacagccaggaatcaggttagactaaatctcatagagtgacagaaaatagtttttgagcaatgaaaacaaacagtgcaaagaagtaaacttatgagctggcaagcagtgcagagactatgtagtcatcaaaatctatttcctcttttcctgggcacagagttggaccacatttcccaactttttgagataagtgttattttcaggccaaggctttctcccttctggctaataggatgaaagatatttcatttcacaggtaaaaacaaatgatatattttgtgtactgaccaacataatactgagaatagtcttaattctcccttttatcaataaagtgacatacttgtcatcatcagattaactacttgagaggttaattttagaggcacacagacaatcctacctccattgcgccaaatatacccttatacatgtagtgtacaacatgtagaatttttaatgactcccacctctgctataatatatgtttcacaatgaaagacaatataaaatgtaagtgatcattgaatggtctccaaaaattgaagcacaaaaataccaaattttatcatactaaggatctgatctgtggcccagctacaagagtaccaacacttacagtttcttttatgggccttaactctttaagaactaattctcaggtttgttctattaagaatatataagcatcttttgctaaacatcagtaacctcttccccaaaagcataaaaccactggaaacctatttctcattattttcattgaaaatttttaaaataccttcttacaagacaatgcaaaactcctaatttcctaaaatgtaacataacagaaaatactactatcctattaggacatgaaacactttgcttcctgagcaagtcataaggttaacaaagacttgctttgcatgcagtaatatggcctgtcctagggatcaccattctagactcacatgtcctttgttgatatgtcatgctttcggaacatcttcaagtgattctgacagtctactaatcctatatagaatgtacctatactttttccaaggagtgttttttgttgttgttttttgacatggagtctcactctgttgccaggttggaatgcagtggcaccatttcggctcactgcaacttctgcctcccgggttcaaacgattctcctacctcagcctcccaagtagctgggactacagatgcacgccaccacaactggctaatttttttgtatttttagtagagagggggtttcaccacgttggccaggttggtctcgatctcttgacgtcgtgattcgcccgcctcagcctcccaaagtgctgggattacaggcgtgagccactgtgcctggcctgtagtgtttaatatgttaaactgaatttttcaggtatatagataaaaattagtcaaaaaacactgtaattagatatgaacattcaaaaagtttggtttattgatacaggtgttctactgagaaagacatttttataagatttcttgtgataaatgtgtccctgaaaatactcaatcttttaaattttgcacttaaaaacctcctacgcaaaaacagtttggtgcagactacttaatacttatgcaactttgtaattagtgttaacaaacataattaataatcaaaataagagtactagtgtacagaaagcatctctaatttccaatatacaatagtaactatagaacaatgcaaaaacaaaaacaaaaaaaccagtaacgaacagggaacagtaacagtagcatattagaaaacagggataaggaaaggtcacaactgctataatgcagacttgagcaaaaagaggagggggcataaagactggataaagccacacaataagcacctctaagatggagcacgtggccaaaagagcagatgagcacattcctcatgtaccacatcccccgcagctggctgcattccactgtgccagcactctacattcagttactggtactctctggtgcacacttactggagaactgtgtacaataaagtcaatgcagcttccacattatactgacacactatatatacagacaacatttacctattttcccatagtgtgtgaactaattcatgaaacagaattatacactctgaagcaacaaagttgtgtaaagtgacgaaaataattttattgtggaaacagagtagaggttataacacaatgccacttcactaattctttcaaacttgattcaaatgatgttagtgaaagttttagaggcaaatgcctctaaaattctctgacttgtatgtcataaaaaaaaagctttctctcttaaaatacaattgcctctgggtgtgtgtaggggtgagagtggaggggcgctaagccctggtagtcattcaaaaatttgattactttgttactaattaccttcactgaagaaaataacttggagttttagtattagcgacaaggtaatcgaattctgaattttggacgtaggaccatttagaaaacaaaagacctgagtgaagactgtcattggtaggtcatgatccttggcagcatgactgtaccaaatgtccggaaggagagtgagaagcatatatctgaaggaaacgtagaattctcacataactatcacaaaattttgtcttgccttcaaaaatggaaaaaacccactgtttcctctttctgcttctttcatcacatcatcctgaggttccagaactcatgccagatacttagtccagttattctataacttaaatagatgttgtggcctagttttggagattcactaccacttaatacatttttcctaagaattttaaaaagttcaaatcaatctattaacaaatgaacttttggcatatgatctgcttctaattagcaatgattagacctgtaaaatgtagttattattcctgtccgttaccacaataaaaaattggttctacgatatcaaaatgtctttatgtcacagaagaaaaaacaaataaaaactaatacatttaaatctcccacatggttttcaggcaacaattctcaattgaaaataaaacatcttacctttaaaatcaattctagcgcctttcttgttcatttttatctcagagcaggagttgttgggggcacctttcgagttctcaaggtaagctgagcttgctcctttcttggagggatgaggatcacagagttttgcattaatcttataaagctcgagggctttaatagctgctgcattattatccatacgaagaaaagttggacaggaagcacaaaactcattcgtgcaggcttcatttccacagccctcagttaactggtggtagtagcgttctattagatgctttgcagctgctcgcttcctgtaccaaacattcaaacaataagcacagtgattagtacagctctcaagtacaaagctcaacatatcatcaaggcaaaagttagtcaagcactgaagtgattaacctgtgtatgaagatgagaagtagaaaatggagatgcactatttaccacaactcctgactagtgaaatagttaataaatattttctaggatattatgataaagaatgtcaatgcttactgactgtattaacagagtatacattcctttggtttaaaaggggggaggggggcttgtctgatggtatatgtgcttaagttgtttagtacaacagctgaaaaatcacaaggtttacagctaagagttgtaggattctatcattttaaaaattagcattaggaaaatgagtctatttaaagcatcaatccggttttcttttacataatcagtatttcatttttaacagcttgtaaacatttgacttatagttaacacagaatatctatctggaataaaaactatttttcccaattatcaacaacatgggagacttaaaaataaatttgtaagtggaatatccaaagatagtgttacactgaaagaaagcggctgcagcctgagtgaggcagatcatgactgtaatcaatcccataactgtgggaggctgaggcaggccgactacttgagcccaggaggtcaacaccagcctgggcaacatagtgaggctactctctacaaacttttttaaaaaaaattagccaagtgtggtggcatgcacctgtagtcccagctacttgggaggctgaggatcacttgagcctgagagtcaaggctgccataagctgaaattgcaccactgcactccagcctgggcaacagagctagactttgtctcaaaaacaaacaaacaaacaaaaaccaaaaagaaaaagaaaaagaggctccaaagtgtagaatcttaaatctaaaacttgtcactaaacctcctcattagttccacgtcacaagatggaatattttaagttccatcacgtgaaatcttatattccttttactctgtcaacttaaagtacacagattaatgtcctattatggctgtttcaggagagctaccaaaactgagggaggaattatgtgaccatgtaagaagttagatgacattatattcaacactaaagagtctatgcttctactaactgataaaattaccataatttcagtagaataaactactggatccaaagaaacataagtcatagccattccttttggtcccaaattcacaagcatggaaataacaactacaaagaatcaaaattataagaaaaatagttcagctgattttcaaaacattcacagaattatctaacatgtaggactagatgaccaatgccagagtttacatcttgctaatcatgagaaactcaacaattaacaaggcagcaagtaagtgaagaaacacacgagatccaattttgtctcaacagaagaactttcactctctgtccaggtaggtgacaaaaagtgataattcacacacattcaattcattctggtgcttatttttcaaatgttccatgcaaatttaccactcactgcatgcaaacagagaaaaaagaaaacccacaaagcacatgtaaaaattgcataaacatgacttaaagacattttgctatctatgaagctataaaccccacctgaaaattaaaaactgttatcacagatttagcactatgcaaaatatgaaagtgaaaacatgtaaaaataaaatggaaatgcagaatctagaaaatttaaaatatatattgctacccttcagtaaagaaagggagataatgtcatgttctcccaaactacagtgacttccctggtgaaaatgtaagtaggtatttcctttctggaggaaaacagtgaacatgtatcgaaagtcttaaaaacacgaataccgtgtgaatgagatcctacttgtggaaaataatttgacaattttacaaaaatgcattgtttctatatctgaaaaaaacatgtctaataaaagattacttaaatgaactgataataggtcacacaataaaataaaaactatcaagatttgaattcgacaaagaactgcctagtcttcctgatatatcactaactgacaaaagtcagttaaaaagtagcaggtgtaggatgaacccattgttatttcaaagcattaatagcattttctctggatgatgtgattaagtgagttttaaaacttcttccatcttttgatttcttatttattctttccatagtaaggatgctacttgcatattaaaaattaataactataaggggaaaacaatagcagttataaaacttcatatacatgatttgaatggccccgagatttactaaattgtctctgatttttaaaaaaattacaaaagtcaaaataccaaaatagatatttttaatgtgagcttttatactaaaataacctccccaaaacttgtcagatacatagtacttctttatatactacataggaggagagtgatcagcacaaacagaacgagactgaaaaatcagaagatctgcattaagtgtcatccttctgtccctaagcagctgtaggatcctagggaaacaattgtctgggcctcagttttcccagctttatgagtcccttcagttctaattttaaagttattttatgtaatagggaggtgagcaagaaactagtatttgctggatgcctgataacttattacacacactgcggggcactttgacatgggttatctcatttgaataccatgacattgaggattatcttcagtccacagccaaagagagaaatagaactggagtcaaatcacgaaaccaagatctcaaagaaagtacagaaccaagacaagaataggagtccaggagtctttcagcttcagagtctaagtcattttgactatattgttttgcagaaggtgattcatttcaaaataattattttttaacatgagtaatactgaagaattctatggaaaaaaatctcataactaatgtgcaactgggaaaaaaatctgaagaatcataacgtgaacctcacatttatgcatctatctggtaccacaaaggcagaccaagtttcttgaggaaatggaaccactatattctgcaaagttaatttctctctaatttgttgaggacctatgtgctatgcattttatagacattcccactttagaggggaataaaccttaacagttaagagctcgcattctgaggccagatgcccaagttcacataatggctctacctcttaattaactatgtgaccctgaatgaattacttgatctttctggacgtaagtttcctcgtaatttaaatggtagtatctacgagcattatcatggtgagagtattattcttcttcacattaccaattgtgagaaaattaaatgtgttaatatatataaagtgcttagaacattgcctggcacatactaagcactatgaaagtgttagctactactattattgttgtaattgttactatcaccctcacaagtgtatgagttagcactataaaccttcattctgctgatgctcagagaaattacataagtcatacatctaataagagatttgaactcagctactaaacttgagcttttaataactattaagaggaggatctgaaagtagccctctatatttgatctgcctttctgtgccaagtttaacaaatagcagctacactgatgagacaggactaaaggaagccatgccagaacctccaagttaatggtggaatcaactatattaagcattcttcttttttcctcactccaatgacaccttaatttatctgacctcatctgcatcactatctaatttaggatatgtaaaaggcatacaaaatttagagcacataaaagggcctctacgttggaaaagtatacactaataacgactttttggtatagttcctgcgcaagggaaatccttgtaccatatgggtcaccaaatcatagctcgtaagtcaaatcgagtccaccacctgtttatgtctctcaagcttagaatattttacatttttaaatggctggaaaaagtttgaaaaataataatagtttgtaacgtgaaaattataagaaattcaagttccagtatccatcaagtgtactggaacatacccaagttcattgatttataaatatactatatatgataatgctttggctctgtgtccccacccaaatctcatcttgaattgtactcccataattctcatgtgttgtaggagtgaccccctgggagataatctgaatcatgggggcagtttcccacatgctgttcttgtggtagtaagtctcacgagatctgatggttttatcaggggtttccgcttttgcatccttctcattttctcttgtcactgccatgcaagaagtgtctttcacctttcgccatgattctgaagccttcccagccatgtggaagtgtaagtccaattaaacttcttttttttttcccagtctcaggtacgtctttatcagcagcgtgaaaaaggactaatacaatatactatatagtttatggctgtttttcatactacaatggcagagttgagtactttaggcctgcaaaacctaaaacaaataccacctgccctttacagaaaatgtttgccaacccttagtttaggatctattatttatctctgccctccagtgaccctgccatctaatcatttggcctcttaactctctctttaccctgagcaaatccgtaaaataaaaggtatacctttccccaagtactattaaagaaaagaagaggagaggggaaaagggaaaaaggggaaaagaaagtgaggaaagggagaggatgcaaaagaaaaagaaggaaagaaaggaatttccctgatgagatcccttagtaataccttatcagctgttcataatcaaaattcctagaagaggaacaacagcttacttgctataatttcttcacattccattgacttttcttattactcaaaaaacaaagtatgttataatgtgttgatttttaaaataaaacaaacttttcttatttagtcagcaatgaaggtcaagtgagaccttctagtaaaagtcctctaaagtcagacacatgaaaatacttatccatttaaaacagacaatactttccaattatttatttctatgattgaattaatgggacagtgctacaaacagaagtcctatggaataagtcatacttggaagatcagagtttactctagacaacttgacagcaatcagtttaaaaatggtttcacctagagggatgtgtactaatgttagcaattaactttgaaaggcataaaaattaagatggattgatggatacaaggatggttatacgataaagcaatgtaagtattaatggcagaatctaggtggcaggcatatgtgtgtcagctgtaaaatttgtgttcaatgtttttttagttcccacatatcagtgagaacatgtgatatctgtctttccgtgtctggcttagttcactaaaaaaatgaatttacaagacaactggaatataagcaatgaatacaagcactaagaagatgaagccatagaaacagctgccagaaagtgaagatgtgacagtgaacgccaaacaagtaagattagaattacaattagaatcagaaatgacaaaaaagaaacatgaactgtgagatgcaatataaaaactaatggtgaacaaagcaaagaataaaaaataaaaacggaaagattaaaaggaaaatgtgactgtaagtagagtgacctttatattatacagaaggtaaagcagaatgaacatgtgaggaatctaaaaaacagatataaaatagaaacaactgaaggcttatataattagtctataaagctaggaaccactgcttagtaatttctcgtaagtggagtctctttgttctgagacgttgcaaaactccattccatctcaaagttatttttaatgttaaaatttgtaagagtgagcaacggtatcctaaatagttctaggccttgtagaaatagactgtaagagacatctgtgacacaactatattcagtatgatgtagggtctgttacaatgggatgaagtgaatttagattatttcaagactaaacctacaattgtgaactcattagtaccatgaaccgaacaaaaacctattaaatatagaacaagacgattttcatgaaaaaataaatatgaacaaatcagtattttcagttgtttgaaatataggttaaccttcaattactgttttatggccgggtgcagtggctcacgccacgcctctaatcccagcactttgggaggccgaggcaggcggatcatgaggtcaggagatcgagaccatcctggctaacatggtgaaactacgtccctactaaaaatacaaaaaaaaattagctgggcgccgtggtgggcgcctatagtcccagctacttgggaggctgatgcagaagaatggcatgaacccgggaggcggagcttgcagtgagccgagacagagccactgcactgtggcctgggcaaaagagcgagactctgtctcaaaaaaaaaaaagaaaagaaaagaactgtttttttcatttttatagtctcaatatccagaatgcgtgatatatgataaaaaaaaaagtaaaattgtagaactaaatatttacataattcatctgtaaaatgaaaatctgttttacagtgtcatatttcacagttagaaaggaagaaaaaccttaaatcaacaaattaactttacatcttatggaattaggaaatgaagaacaaatgagactcaaacttaccaaaaaataaaaaaaataaaaataaattacagctaaaataaaatagagaaaaatagaaaatttttgcaatagaaaaaaaatcaacaaaattaggagtagctgttttattgaaaagatcaacaaaactggcaaattcttagattaagaaatgaagagaatagacacaaacagcaacaactggaaattagaaaggcgatacaacaactgctgccacagaaataaataggaccttaaaagactaatatgaacaactatgacccaaaaaaatttgataacctttgagaacggatagacacatcaaacccaccaagactgagccacaaatacatacaacttctgaatggacctataactattagagattgaatcagtaactgtccaacaacgccagggcttcactgaaaactctaccaaacatttaaaaactaacaacccttctcaaactctttgaaaaaactagaggacagaacactttcaaaatcattttatgaggtaagcattacttagatatcgaaatcagacaaatttacaagaaaaaagaatccctaataaatactgatgcaaaaaaaatcaacaaaataccaagaaacagaattcaacaatgcattaaaaagattatatttcataaattctcaactggaatttattcataaaatccaaggatggttcaacatacaaaaaaatcactttaatacactgcattcttaggacaaaaaccaataatctcaactgactcagaagaagcatttgacaaaaatcaacacccttttaggatttaaaaaaaggccagacagggtggctcatgcctgtaatcccagcactttagaagggcaaggtgggtggatcacctgaggtcaggagtgtgagaccagcctggccaacacagtgaaaccctgtctctactaaaaatacaaaaactaatcgggcatggtggtgggcgcctgtaattccagctactcgggaggctgaggcaggacaatcacttgagaacccgggaggcggagctggcagtgaggtgagatagcatcattgcactccagcctgggtgacaagagcaagattctgtctcaaaaaaacaaaaacaaaaacgctcaattcgctagaaagatatggaaattacttcaacataatgaaggccatatatagaaagaccacagctaatgttattcaatgatgaaaaactgaaagttttccctctaagatcacaaatggaacaagaatgcacacattcaccacttctattcaacatactgttagacatcctgccagagttagcaactgggcaagaaaaagaaatgaaaggtattaaatgagaaaagtaagaagtaaaattacttctgttagcaaatgacatgatcttttatgttgaaaactctagcctaccaaaaagaaaaaaaaccgttagaataaaggaattcagtaaagttacaggatataaaaaccaatattaagaaaagagttgcatttctaaatactaaaaatgaagaatccaaaaaggaaattaattttttaaacccatttaaaatgaaatcaaagagtaaaaaatacttagggaatattttcaccaagcaaatgaaagacatgtacattgaaaattaaacaacataggccggacgtggtggctcacgcctgtaaccccagcagtttgggaggccaaggtgggctgatcacgaggtcaagagattgagaccatcctggccaacatggtgaaaccctgtctctactaaaaatacaaaataaattagctgggcttggtggcgcgcgcctgtaatcccagccactcgggaggctgaggcaggagttgtcacttgaatttgggaggcagaggtgcagtgagccaagatcacgccactctactccagcctggtgacagagtgagactctgtctcaaaaaaaaaaaaaaaagaaaaagaaaattatacaacaatgctgaaagaaattaaagacaatacaaataaatggaaagacatccaagtttatgaattggaagatttagtactgttaagatggcaatactacccaaagcaatctgcaaattcaaagcaatccctatcaaaatcccaatggcattttctacagaaacagaaaaaaaaaatcttaaaattaatacagaatcttgaaggaccctgaatagccgtaacaatctggacaaaaaacaaagctagaggcctcacattccctgatttctaaagatattgcaaagctatagtaatcaaaacactatggtgctggcataaagacagatatacagaccaagtgagcagaagagagaacacagaaatagggaaaagaggttcttcaacaaactgtattgggaaatctggaatctaacatgcaaaagaatgaagttggagccttatctcacaccatatacaaagatgaactcaagctggattacagacctaaacttaaaacatcgaattataaaactactacaagaaaacatggagaaaaagcttcatgacattggacttggcaatgatttcttgaatagatcaccaaaagcacaagcaaccaaagcaaaaatagacaaactggggatacataaactcaaaaatttctacaaagcaaacagtaaatggagtaaaatggcaacctacaaaacaggagaaaatatttctataccatgtatctgttatttggttaatatccagaatatataaataactcctacaattcaacaacaaaaaatctagttaaaaagtggacaaaggacttgaatagtcatttttccaaagaatatatacaaatgggcaataagcccatgaaaagattctcaccatcactgatcagtagggagaaatgtcaattaaaactgcaatgatacatcatctgaaaccattaggatggccaccattaaaaaaacagaaaataagtattggtgaagatatggagaaactggaacccttatgcaccactggtgaaaatgtaaaatggtgccaggcactgtggaaaacaacatgaaggtccctcaaaaaatttgaaatagaattacctccagttccacatatgaagagcttggaagtcaccactccatcctaacaacaagtaaaaaatgacaaacttaaaaataaacaaatctgagataggataagtgaggtcacagggcaaatgactgcctgtgagagcagagaacaggtgaacacatagcatcaccatttatctgagatgaaaaacacaagcagaaacctccacggggtaggaaatcctgaagtgtaatagacaaattgatgaaggctcagtgtggacaactctgaaagctaaaaactccagagttacccaattatagggggagccctacaattttctaagttttacatccaggcaattgaccagcttctcacagtaaatataggagaaaaatcctcaaccctcagcaggggaggcaaagagaaatgattttcaagtacactagactattccagtcttaacaaggtttgtcctcaggagaaactagttaaccagagcctaacctgctggggttgtagcaaagccaaaatgatgtgggggaagagaaataacccaacttcaggccattatagctatcttgttctaactaagggaatgagggaggggtgggattgagaaacacttgtgaagttcacagtccagaggcataagctcactaaaaagactgacctaatcataagactacagaactcttctcctctccctacaccttacaaccacattactaaatgctcatttacaacagttccttttacctagtacatcatgtccaagctatcaagaaaaaaattacagggcataataaaaggtaaaaaacaagcaccaggaccagatacagcagggatttggaattatcaaacttggaatctaaaacaactatgattaatatgctaagggccctaacgaactgagtaaacaacatgttaaaaaagtagagatgaaaatcctaagaaccaaaaggaagtgctagagataaaacacaaacaaaaacaaaaaacagaacactgtaagagaaatgaagaatgcctttgatgggcttattagtaggctgggcatggatgaagaatctctgagcttgaaaatatgccaaaaaactacatctgggcataaaacgttgtaattacagaaattcaaggataagaaaaaaatccgaagtaagccagagggaaaaaatcaccttacctgtagaggaaaaaaagaaaaaaaagaaaaaatacatgtgacttccaacaagaaaaagagtgaaatattcatagtgttgagagaaaaaaaaaccataaacctagcactctaccttgtgagattattattcaaaagttaaaaagaaacactttctcagacaaaaattaaggaaatttgttgtcagtacacctgccttgcaataagtgttgggaagttcagaaactgaaatctacatatatagagcatcaaaagaaggaaacactgaaagtaaaataaaaccttttatttttcttatacttaattgatctaacaaataagaatttgttcaaaataatgtcaacaattgtgcttatgcatacaaatgctcctaaacttacttattgggttgtgtcccaataccattataaattgaaaatatcatgaaaacacaacttatccaaatttgtgggatacagtgaaagcagcgcttagaaagaaacatacaacactgatgcatttattagaaaagaattatctaggccgggcgctgtggctcacgcctgtaatcccagcactttgggaggctgaggcgggtggatcacatggtcaggagatcaagaccatcctggctaacacagtgaaaccccgtctctactaaaaatacaaaaaaattagccacacgtggtggcaggcgcctgtagtcccagctacttgggaggctgaggcaagagaatggcgtgaacccgggaggcggagcttgcggtgagccgagatcgagccactgcactccagcctgggcgacaaagcgagactccatctcaaaaaaaaaagaaaagaaaagaatgatctaaaaatcaattatctgagctaccaacttatgaaactagaaaaagcaaattaaatccaaatagaagtaataaaaattagagcagaaatcaatgaaattgaaaacaagatatcaatagagaaaaatcaaagaaatcaactagttctctgaaaagatcaataaaatcaataagcctctagccaggctaagaaaaagagacaaaggacaaaataactaatatcagaatgaaaagagtggacatcattacagatctcatggacattaaaaggataatcaagggatattatgaacaactttacggccacgaatttggtaacctagatgaaatgaatcaattccttaaaagacacaatctattagaactctaagaagaaataatcttgattaaaaagcatatattaaagaaattaaatccataattaataatgttctaaaagagaaggcatcaggcccagatggattctctgatgaattctactaaacatttaaggaagaaaccacaccagttctctacaatctccttcagaagacagaagcaaaggagatgctcctatctcattgtatgaagtcagcattactctaatacccaaaccagacaaagacattatcagaaaagaaaactacagacccatatttgtcatgaacaaagatgcaaaaatctttgtattagcaaagtattagcaaactaaattttactacaatgtataaaaagaagtatacaccagcacaaagtaggatttatcccaggtatgcaagactggttcaatattggaaaatcaattaatgcaattcaccatatcaacagactaaagaagaaaaatcacatgaccataccatagatggagagaagtatgtgacaaaatttaacacccactcatgatagaaactagtaaactaggaatagagggaacaccttcaacttgataaagaacgtttacaaaaaacatacagctaacaccatccttaatgatgagaaactagaaactttcttactaagatcaggaacaagaaaagaatatccccacctcaccactccatactggaagtcctagctaagacaagaaaaggaaataaagggtatactaacggggaacaaaaaaatacaactgcctttgtttgcagatgaaatgactatatgtgtagaacatagacaggaattgaaaaaaagaaaaagaaaaacaacaaaaacctcctagaactaataagtgattatagcaaagctgcaggatacaaggttcatataaaaaagttaatagctttcctgtaaaccagcaatgcataagttgaatttgaaattaaaaacacaataccattttacattagcgtgtcccaaaatgaaatatttaagtacagatctaacaaaattagtacaagatatatgaggaaaaatgttttagaactctgatgaaagaaatcaaataactaaataatgaagagctattccatgacccgtgagagacaactcaatattgacagaaaaagtcagatggacactactgatttcaagatttactgtaaagctacagtagtcaagatggtgtggtactgacaaaagaactgacaaaacagaccaacgaaacagaatagagagcccagaaatggacccacatagtcaaaggagcaatggcagtatttgacaaagaggcaaaggcaatacaatgaagaaaatagtctttttcaataaacagtggtaataactgaacatccacatgcaaaaaaaaaaagagtctagacacaggtcttacacccttcacaaaaataaactcaaaataaaccagagaattaaatgtaaaactcaaaactataaaactcctagaggataacataagaaaaaatctagatcttgggtttggtgatgacttttagatacggcaccaaaggtaccaaccatgaagaaaagaactgataagccagacttcattaaaattgtctacttgtttcttaaaaattgttgtcttttgcaaaagacaatgtcaagagtatgaaaagacaagccacagatagggaggaaatatttacataagacacatctgataaagaactattaactaaaatgtgtaaggaggctgggtgtggtggctcacatcccagcactttgggaggccaaggtgggtggatcacctgaggtcaggaggtcgagaccagcctggctaacatagtgaaaccccgtgtctactaaaaatacaaaaattagccaggtgtggtggtgcacgggtataatcccagctactcgggaggctgacgcaggagaatcacttgaacccaggtggcagaggttgcagggagccaagactgtgccactgtactgcaacctgggtgacagagcgaggctctgtctcaacagacagacagacagacagacaagacagacagagacagtgtaaggaactcttaaaattccacaagaaaacaaacaacccaattaaaaaattggccaacaaccttaacagacacctcaccaaagatatacagatggcaattcagcatatgaaaagatgtcccacacatcatatggcatcagagaaacacaaattaaaattataagatacctctacacacctatcagaatggacaaaattcagaacactgataacaccaaatactggtgaagatgtagagcaaaagaaacactcactcattgctggtgaaaaatgtaaaaggatagcgtcatattagaagacagtttggatgtttcctacaaaactaaacacttttaccataagatccagcaattgcactccctagtatttacagaaagtcgctgaaaacctaagtccacacaaaaacctgcacaccgatatctacagcagttttattcataattagcaaaatgtggaagcaaccacaatgtccttcattaggtgaatattcattcacaaactgtgatatgtccagaaaatggaaaaagagaggtactaacaacctatgaaaagacatggaagaaactttaatgcatattagtaagtaaaaatagtcaagctgaaagggctatatactgtatgattacaagtatataatatgctggaaaaggcaaagttagagacacagtaaaaggatcggtgattgccaaggagtgggagggaaggaaagataaataggcagaacacagaggattttggggcagtgaaaacattctgtatgatataatggtagatacatgtcattgtactttgttcaaagccacagaacgtacagcactaagaatgatccctaatataaactacggactttgggtaattatgatgtatcaatataggttcatcagaaagacatgtaccactctggtgggagatgcacactggctatgagagaatccatacatgtgtgtggaaggaggtacaggggaaatctctgtaccttcctctcaattctgtgaacctagaactcctgtaaaaaaaaaaaaaatctaaaaaaaaatagaatacatatgatccagtaatcctacacctgggtatacttccaaatatattaaaaacaggttctcaaaaaaatatttgtatacccatgtttatttcaacattacaatattcaagaagtggaaggaacctaaacatccatcaacaaatggttaaagaaaatgtggtatacatatataacaaaatgttattcagcctaaaagaaaagaaagaaattctgtaatatgctacaacacaaatgaaccttgaggacattgctatgtgaaataggccagtcaacaaaagacaaatacttaatgattccactgacatgaagtagccaaaacagtcaaattttagaggcaaaaagtagaatggcatttgccaaggaataggaagaagggggaaaagaagagttgttcaatgaatgtagagtttctgttttacaagatgaaaaagttctagagatctgctgcacaacaatgtgcacagttaccacaattgtaccgtacacttcaaatcattaatatggtaaaatgtgttgtttttgacaatttttaaaactctaccccattgttttctttacctcttatataaactgataaaaacctgttttatcttaatcaattattgtatgactactgctccccagagaaaaaagtgcatgtgaaatactactacttatccatctcctggctctgagcagtacatgtcaggaacaagagggaattgtagctggaagacagtagaagagccataggacaagtctctaagagaaggaagaaaaggcgcaatgaaagaaaacaagtttaagatagtagaaaagcattcaaagacggcaacctgaggtaaggtgttttcactgaagcttttggggtaaaacagttttgagttggcatgcctgtagacatgggaagcagcagtgatgcagaggtgaacattactgtagataaaaacggatgggaatttgacttgctagggactgaggggttaatcatataaataaagatggcagcagatttgggaaagagtgaagaagaataagttcaggtagcagtcctcaaaaaccgagaagaaactgatagctcactgaaggcagacagaggaagacaaaaccagaaggcataagcttcaaaggagcagggatttttatgctgagagagtaaaaggaatagttcaaagcagcagtggagaacacgaataacgttccatgtgggaaaagaacatgtccagagcttactgtacctataacctagcttctgtaactggaaatgaagaatctgctctagtcaggtcatcacttttcactacttattttacttggccttcctaagaaatatagaccttttggaaattattgacttttgggtctaggacactatttcttggtttcctcccttctctctggctgtttttcagagacttcccttccaaatctagagacatttgtattctccagggatcagctattagatactttcccttttaaatttccctttggacagtttcatctttcaaggattgagcaataactaaatgacttccaaatgtctacttcagtataaattctgcttgtcaggctacataaaaagggctcttcaaggaattatgatgtctaaagaaagagaaagccacgatttcaatatcacagagatgactacagaggaatagcaataaaaagagaggcaacttaggagaggtgaatcacaaaagatgactaggagctgatgacactatgggtgggaagaatgtttcagacaggggaagaatgtttcagatagaggaaaatgagtaaaagcacaggggcctgaaaacatgatattataagacaattccaagcacttcaagagcctaaagttcaagaaaagtttcaaaaatatgaaaatggagaggcagggaaaagccagatcatggaagacctcaatagccatgataagtaattctttttttagccaaaagaggagtaatctaataaaagctaaagatcttctcctcataaaaatacatgcacacttcaggagtgcaaatgcactcttccggaagattcgtaacccactacattcataaaccattagataagaactaaaacacaaggagtcactgaagggttttaagcaggttaagtgactgacaaaatttgccttttcaataactgaaaccaaagtgggcaaaactggaggcaagcaatccagttaggtaatgactactgtaatagtccggacaaataatgtagcagtaggaagaaaaaaaaagatgaaattgacccaggaaatatttaaaataagtagtttgtaagaggtaaataagctggaagagccagaggtaatgggtagggtttctggtatgggcaacaagatatgctacaagctgagatgttagtaaaaacaagcgttcatcagcatttagtaagtgatttatttatattatatcactgaatactcaattatgttaagaggcagacagcagttaaaaaacaaagaactcggtgaatcaaaaagttctgctaatttggggaaatagcatcccttttatttttgttaatctcttttgggtttgatcctcatttatagctgacaagaagttctatgtactaaaggtaaactattctcattaatgttcccaaaaatctcttggaataattaagatataaagaaattcaaaattcacatgattataaaaatctttccttagataatctcataatatagccatgttttgctcattctactttgagaagattcagccagaaacagttcatccattcaactatccctactgtgaactagaagtatgtttccttacatttgaaacagaagatataggtttatatgatgcttcaggtggtagaaaagcagggcagactatgactcgtgtcacttccttccacacgtgatgcctttcatgggctcctgtgtctgtcagaagaaagcaaagggccttagcgtgctcctggctttctatatccaaatgcattttttcacaccttctcccatcagctaactctacattactgcaatacggaacttcttactactcagtggacttgttctgctgtcttctctgattccaggtgttattcttcctgcctagaacactatgattcttagctattcccaagcatcctcaaggtttcagcttatataccacttttaagataattaggtattcttcctctgtagtctcataccaaccagtacctattctattatatataataactgcctattaattaaatgggaagctgaggtatatgacctaataacttatttactgtcgtatcctcagaacctagcaaattacagagtctcaacagagatttttcaatttctcttctgatactgtctcgataacagtgtcaattaaacctttctctaattatttgaccttgaagggaaatagatgtcagactacctcctggtttcgagtatactggaagcatacaaaaggaccttctcaatctggagaccaagaatatgatatgagaacctataggagaaccacttatttgattaaagagatttcttttacttcagaaaatatttcagtatgttacttgacccataaatgcttatagatgtgtaagtacaccgaagaagtcatataggaaataaaagcatccaagctatatttctatggtctactctgattaaaaagctcagctctcctatcaaattcaagataatgcatgtggattatggagcacagtcacttgctacatggtaaatgctcaaaaagatgataggtggtattacccacattctacaggctgtgtacatacttatcagtttatatatatacataaactgatcctaaaaaattcttcctacatttctgcaagataattaaaaaggcagaaacaaacattttgcataaatttactagcttcattctttcatgtaggaagtagttactgactacctactgtatgccaggcactgtcattaggcttccattctagtggtaaagaagcaaaacaacaaagaaatcaatatgcaagaagtcaaatgacattaaatcccatgaagaaaaatgcagcaagttaaggggaatgcagaagaacatgatcattctttgatgcagccggtcaggaaaagcatcatttgagcagagagctctctgaatcaagtgaggaaggaagccacatggattatcacagagaagggtcacagggtcacagacaatagttacaagccttaagatgacaaagatacagccattttagacagagatgagcaagtgcggtagagagatcacagaaatgaaaggaagccagttcacacagggccatgtaaatctccagattttacttttaagatgggaagcctctgaaaagttctgtgcatagtaaataacatggtttaactcagattttaaaaagatcattccggctgctactagagaatacactgtaaagcacaagactcctgggaaacaatttctttcttttgccaaaagatgatgcctttaaacagagtaaacagaagtataatggttaaaaaaaataaaatgaattatgggtatttggaaggtgtagccaacaagatttaccaataatttgagtatgtgacatagagaaattaaaagatgcttccaaggcttctggctgcacaggaggggaaaaaagctgttattgactgagatggcaaaatattatgagagacgtaggtttgggatgatgaaaatcaggagctccacttaggacaggttaagtttgagaaccagacttaactgttggataaatcagtctacagttcagagggcaagagctgacgatggaaatagaagagttgtcaatagacagagtcctggggcatttctgacatttacagtaaactgagcatttattaaaactaacttgctttactgaaccataaatcacttgttgtatttacccctgctccatttatagttatacatctggaaacatagccttagtgttagaggtaaagagtaaataccaaacataaaaaatctgatctggttgggtgcggtggctcaagcctgtaatcccagcgctctggaaggccgaggcaggcagatcacgaggtcaggagttcaagaccagcctggccaatatggtgaaactctgtctctactaaaaatacaaaattagccaggcatggtggcacatgcctgtaatctcagctactcgggtggctgaggcaggagaattgcttcatcctgggaggcaggggttgcagtgagccaaattgcgccactgcactccagcctgggtgacagagcaagattccatctcaaaaaaaaaatctgaagttactgagaaactggtatgaaatcattaagaaaactaaggtgtctaaattaatacatacaaagagattctacaacacggtatttataaatttaaacaaaatccatggccaggcacggtggctcacgtctgtagtcccagcactttgtgaggccaaggcagaaggattactttggggccaagagttcaagaccagcctgggcaacatagtgagaccctgtctctacaaaaaacaaacaaacaaacaaaaacactgttttagcctggcatggtggcacatgcctgtagtcccagctactcaggaggctgaggcatgaggatcacttgagcccaggaattcaaagttgtagtgagctctgatcacaccactgcactctagctgtatcacttatgacagagcaagacaatatctcaaacaacaagcaaacaaaacaaaaaactaaagtaaatccaggtaaaataaacatacgaataaatgaaaagatctgggttattgcattagttctgtttctaggcttaactacaaaatggtgtccagttgttaaaaacacttgtttaagagtattaataatttttttttttactatgctcttctacatcctaggaaattggcaacactaagaattcctaaaaacaaacaggagtgttaactgtatataaattattatttaagatgcattcaaggcgttacttaaaatatcaaatgcatgtcaaagtacaaacaacaaaatcatgcttcaacaaatgtgggatgttgccattaatggacagttagctctgaggtaaaaccaagaatccttcattacctatttttgtaaattaggacaaatactattaaggtattaggttggtacaaaagtaattgaacaaacctggacccactcacctcactgaaagtgctgcctggctacagtttctagatataggaatgtgagaaatggtagcagccttgaaggtttagagctatattcccataccaattatggctagaaacttaaaacagctctattgagacattatgggaagtctaatttcctgttactctactttaacacagccaagtaaaacagtaagaaagcttgcttaattcaacaaggactgagtgccagagtgtcacctggaaacttgtgacaaataatcatgcctcacacattcatccttggtttttactaccaaatgcaagcttcatctatcctcttccattctaaacttgactcatcctcctaacctcttccagaaagatctctagaaacccagaggctttctgaagacccataggctatcccccatcttcaactactttacataatggcccctcaacttcttagctttcatgaaagcctggctcctccccaaaggcactgcctatcatgcaacccttttatgtgactcctaaaactcctaagtccaccattattcttctaattccctgtattaaaaataaacggcaaaattccctgtattaaaaacaacaaaaaaacagcttgtaatttgaaactcatgtcatctaaccgaatgccttctctttccctccctgttctggtcaattaaacccacatatttaagcctccactttgcccccagttacatcatcagcaaagtgacttcaatgtccctgtacatggttctatcccaatactctaggcccccaaaatatttgcctttctaaatttgagacatcttcacctcctcatttcagcaaatcactcccttgtctttgttagacatactaaaacctctgacaatgatcatctcagctatctttgtaagagtttcactcatactcatatctcctttcacctgtcaagacaccaggtttggtgacaaataaaaatgatacgtatttgggaggctgaggcaggagaatcatttgaacccaggaagcagaggatgcagtggccaagatcatgctactacactccagcctgggtgacaaagcaagactctgtctcaaaaaaaaaaaaaaaaaaaaaaaacacaaaaaacaaaaaaaaggatacatatttattgtattcacatgatgttccaaaatatgtatacactgtggaatggctagatcaagctaattaatacatgcaatacctcacatacttatattttatggcagaacatttaaaatctactctcagtgatttccaaaaatacactgttattaactagtttccatgttgtacaatagataccttgaacaaattcctcttaattgaaattttgtgtcctctgaccaacacctctgcaacccagtccactcacccccagcccctggtaaccaccattttacatccctgagttaagattccacatttaagagagatgtagtatttgcctttctgtggctggcttactttcaacaatgccctccaggttcatccctgctgtcacaaatgacagcatttcctcctttttatggctgaagtatattccactgtgtatacataccacattttctttatccatgaacacttaggctgatgctgtatcatgggtattgcaaatgataccgaaaggaacatgggagtacagatctcttcagcgcactgattttattcttttatttatatatatatatatatatatatatatatatatatatatatataaaaatacatatatatccaagtgtgactgctgaatcatatggtagttctattttttaatttctgagcaaacgtcatgctattttccataaatgctgtactaatttacattcctgccatgcgcaatatatctcttgtctgcaaatcctcatcatactttaatagccattctaatggccatttgtatgtcttattttgagaaatgtctattcaagtcctttgcccatttcttaagtgaggtgctttcttactattgagatgtctgagttccttatatattttgcatattaaccccttaccagatatatggtttggaaatactatcttccattctgtgagttttttcattctgtagattttttctttttgccatgcagaagctttttagtttgatgtgatctcattcatcaatttttatttttgttgcctgtgcttcgagggggtcatatccaaaaaaatcactgtccaaaccaatgtcatgtacatttctcctatactttattctggtagttctacagtttcaggtcttatatttaagaccttaatccattttaacttgaatttggtatatgatgtgagatacaggtctgatttcattctcatgcatgtagatattccattttcccaacaccacctattgaacagacttccctttccccgctgtgttctttgcaccctgtccaaaatcaactgatagtacacgaatttatttctgtgctctccattctgttttgtgggtcgatgtgtctgtttttttgtttcttttgtttttaaaagacagggtctcacgctgtcatccaggctggagtgcagtgatgcaatcacagttcactgccaccttaagctcctgagctcaagcaatcctccttcttcagcctctcgggtagctaggactacagatacacagcaccgcgcctggctttaaaaattttttttttttttaattttagagacagggtctcactatgttgcccaggctgctctcgaactcctggtttcaagtaatccttctgcctcagtctcccagagtgtgggaatacacgtgtgagcaactgtgcctggcctgtctacttctatgtgactatcatgctgttataattactgtagctttgaactatattttgaaatcagatagtgtgatgtctccagctttgttcttttcactcatgacagctttggctatttaggatcttatgtggttccatataaattttagcactgttttctagttctgtgaaatttaacattggaattttgatcaggattgcattaaaactgcagattgctttggataataaaaacattttacaatattaattcttccaatccataaacacaagataactttccattatttgtatcatcttcaatttctttaatcaatgttacatagttttcaactctttggttaaagttatttctaagtacaatcatccctcggtatctgcaggatattggttccaggatctcctgtagataccaaaatccatggatgctcaagtccattatataaaatggtatagtatttgcatacaacctacacacatcctcgtgtatactttaaatcattacttagtacctaatacaacgtaaatgctatgtaaatagttgctatactgtagtttccttattgtataagaaaacagtatttttattgttgtatttttttctcaaatattttcatccaaatgttggttcaatttgcaaatgcagaaccactgatactgggagccactgcatgttttgtttttggtacctattatacatggaattgtcttcttgatttttcttttagataatttgtcattaatgtacagaaattctacggatttttgtatcttgattttatatcttacaactttactgaatttatcagttctaacaattctctggtggagtctttaggtttttctatatacaagatcatgtcatcttcaaacagggacaacaatgtcttcctttcctactgggatgccttttctttctcttgcctaattgctcttgcaaggacttccggtactgtgctgaatagaaatggcaaaagtgggcattctcgttttcttcctgatctcaaaagaaaagcttttaacttttcaacattcagtataacgttagcagtgtgtttgtcaatatggcctttattttatagaggtacattccttctatacttaattttttaaaattttgtagcacaagagaatactgaattctgtcaaatgctttttctcaattatctcaattatctattgaaatgataacatggttttggcctttgttctcctaatgttgtatatcacattttatggattcaggtctgttggataatccttgtacccttgaggtaaatcccatatgatcacagtaaatgatccttctaatacactgttgaatttagttattattttcttcagaatttctgcatctaaattaagaatacgggtctgtaattttcttttcctggagagttcttgtctggctttggtatctaggtaatgctcatctcccaaaatgagtttgaaattactccctcttcttaaatttctcataaaattatgagaacaatctgtactagttcttctttaaatgtctgctagaattcagcagtaaagtcaccaagtcttgggcttcctttggtgggagatatttttatgactgatacaatccttgtcactggactgttcacatttttcatttcatgattaagcttggacaagttgcatgtgtctaggaatttatccatttcttctatggtaatcaatttgttggcatataattgttcagtctcttatgatcctcttatttcttgtacttctctggtatcagctgcaatggttcctctttcatttctgatttaacttgagtcatctctttttttcttagtctagctaaagacttgttgcttttatcatcaaaaaacacaactctttattttttttatcttgagtcatctcttttttccttagtctagccaaataacctgtcttttgagttcagattcttttgtctgcttgctcaattctgcttttaatgctcttttgcatttttcattccatttattgcattttcagcttcagaatttgttaaaaaataatttcaatctcaaaatttctcattttgattgctgttttcctgattttgttgaattgtttatctgcattttcttgaaattcattgagcttccttaaacaattactttgaattctttgtcaggcagttcatatatctccatttctttatggttggttcaggtgccttattgtgttcctttgactggtgtcacgtttccctgactgttcttgatccctgtagtcatgtgttggcacctgcacatttgaagaagctgagacttgttccagtctttgcagagtgactttattgggtaaagcccttcaccagtcagcctgtccagagattatgcagcctgagtctaccggggctggcctggagtctgggtcagcagggtaggtcctggagccttggtacacaggtgctgctggcctggcatcctggtctactagagtgagcctgaaccttggatctgcaaggaccagtgtgaaggctgggtaggtggatgttggcctagaatttggatcacaaggggctggccaagtactgggtttggacccttgttctgcagtgatgtgaggccacaggggccgatctagagggcagggctgcagggaccaccctagcactagacaggcttagagcctagggctgtgggatccagcttggtgctggggtgggcctccaagcttggtttgtgggtattggcctgaagtttggggccatgggggcctgcctagcattgagttttactggggcgagctcaatgttagggtctaagtctggtgtacacttcccctccttcccccaggtgaacagtctctctctccatgctgggatctcagggactgagggaggtgtgacacaagtaatgtaaaactgtccttcttacccttttcaatgtgtcttttcttatctgtgtgccacattcaggtaatctctcgtctggtttcttagctcttatatttttgtgtgtagacagttgttcaaattgatggttctacaatgagatgagtgctgcaaagtgctagtctgccatcttgctgttatctagacctcaggcttttcttaaaacaactcaacactttggtctggcatcccaacctttccaatcatggccatcatccacagcatataaattcaaatactccaatgttaacatcttatgcacatgccactaatgattctgttccatcagctctgctaatatccaaccctaaaataccatgcataatcttctggctattggagaaaagtctttaaatttcaaatgtgataaagtctttaatcttaactagtcactcagtggaatgagattctcctactctgatacggtttctgatttcaggtagccagccagtcaagactctcaacttctgatccacttcttcacccattcccctcagtagcttcctaagttttcagtcttctcaaaacctctaaacaaaccttgtattccacaaaatattattaaaaaatgtttcataaaaagtttcgtggtcactaacctacagtaacatactaccttatatccactacaatgactactattgaagtacacacacacacacactctcacacaatatgtgatggcaaggatgtagagaaactggaccccttgtgcactagtggtagaaacgcaaataggtacagttgctctggaagagtatggcagtttctcaaaattttaaaaataaaattaccatatgatccaacaattccacttctgggaaaacaattcaaagcagggtctcaaaaagatatttgtacactcctgttcatagcaacattatctgtaatagctacaacatggaagcaacctgagcgctcatcaacaggtaaatggataagcaaaatgtggtatatacatacaataaaacattattcagcctgaaaaaggatgcaaattttgaaacatgctaaagatggatgaaacttgatgacactgcgaagtaaaataagccaatcataaaagggcaaaaactgtatgattgcacttatagggggtacttagagcagtcaaaattagacacaaagtagaataatggttgtcagaggctgtgaagataaggaaatgaggaattattgtttaatgggtacagagtttcagttctgcaaaacagagagttctgatcgtgactgtgcaacaatattaatatacttaataccattgagccaaatacttaaaaatggtgaaatggaaaattttacattatgtgtattttactacaattttttaaagcttaaaagacaagtcacatggttgggtcacataaatttgagaaatacattttatagtcgtttcttgcagattcacaatatataccggcatttaaataaggttccaatattttcagtaaaaaaatcttgatttttccaccctcacccacaattacaattaatatcacacatccatctttacttccttgttctaatttcattagatgggcatctttcctcttattcaaggtcaatcactatatctgcatttttctttttttatattacctgtatgagagatacacctgtatttttcattccaacccttaatacctcgaaaaactttgctttgataattactacctctattatctgaaacatctttagtcttcacaataaatcactaaagtcttacttacttcatgtcctaaatatttgtcttaaatccagaaaaatttattttgaattcctattataccactgtcattgtcaaggctctcactgactgaactaccttaccaccacacgtttctcttcaatcctttctctcttgcaaggttattaaaaatacacgtttgacaaacttactatctacctactgagcaaattctttgctgactccctaataccttctatcacatcttatcttcttcattttcctacctctcagctagtttatgatctaaaagtcctcaactgcctattgtcccctactccctatgctgcttctaactttggctcatacttctgcctggaataagccgctcatgcttctagctgcctgattcccagtcacatttcaagactgaacttagcatttcctggccactcttacttccctgccatctacactagattcctattgcatacctgggtactccagtactccttcatgttactattgtattttggataccattctacctcagtgactgaaattatttgcttctgcatctttcactcttgagtataatataaatttctgtagggtgaaaactaattattacgcatctctgtatctataacatagtacttgatgccttaaatatggtaggcgttgagactgttaaactcaactctttcctcaacctccctatttccctacaactgctaccagggaagcaaaaagactaagaatttaggcgtgtgcatttatctatctagtagtagaaacctagtaaactgttaccgaggtttagagttatctgataggaaaaaaagtaggtatgttcctatctcccatttactgctaaatgattcctttcttttaaccagaaattatttccaaataatgtgacgtaatttaaagcagtctagggcaactcaaaataagaaccacagtctcaaccaagttacacttacattcggctagcttcaatgtcgtcagactgaggttctcctgatctgtaaaatgcaattgagaaacagttagcaaaatattccatattccaaaaaaaaaggtagacatattacttaggaagacaattttgtaaacaagatttaagcactaaataaaacagttttaaaattaaagatgtcaacatgaaagaaagtggtcagatcaggtggccatacaacacatttattttaagggttggactattaaaaaactcaatgcatgttttttaaaggaaactgtaaacgctatacatagataccaacagacaagccattataagccataattattcacaaagtcaaatacgtgtaataaaacacacaactaaaaaacttcctatagccaagtattggttatccacattaacaaaggtactcactggtattcactcacagtattaaactttagattagtggctcagtaaactactccctaggcagacagactaaagcttaggccagccatgtagttttgtaaatgaagttttattgggatgcagccatactcattcatttaggtatcatctatggctgctttcacactaaaagaacagagctgaggacttgtggcagaaaccacatggcccataaagcctaaaatatttattttctggccctttaagaacaaatgtgccaaccgctaccgctactccagacaattcaaactaaaatctaataccttggtaagtttaaagacacttaaatcagatacaacattctaatgatgattatcttggttcaacaatgaaactgtttccctaaaaatacacttactgtatgtattacctgtcaaaagtgtatcacctgaggtgaagttttgcactggatagctgtgaattaacttcagttttaaacagttgccagttactttgttatttctaaatatactactgctctctcatgtagaaatatttaaaattctaagtcactaaaaagcctttcattttcatttcacgagatatgaatcagtatttccctatctattcacttttataaacagcatcagcaacaatgaatgagtcaatataatattgatttctaacacttagaaattcccaaactagataaaaaatgttttttgaggtcaaaagctaaattttcaaattggcattacaaagtcctgatttgtgaacttctcactgactttaggcttccaactttaagcaactctaacaagaatcttaaaatcagtcacacacacacacacacacacacacacgcacacacacaaacctgttttctaaatttcttagctaaaaacaaaaacaaaaacaaaaaacaacccctcacttctttatcagactctcaaaattaccctcactgcaattcattcagattccaaggacaagaatggaaaaggaaaaaaaaaaaaaaaaaagactccagcagctcaaatatttattttagatcttctttgcaatgtatttaaattttcaattttgcacaaaattacataacaactaaaaactggggcatgctggaggtggcagtgacttggctgtgacacaaatgcaaaaatttcactccaccctctcccccagggagcaagcaaatcacctatgtgacacacctggtctccaccagccttgtgggtaagtaccccaagattgcttccaaacttgtatctcccagacagaagagctaaaaattgatgataaccccatgtaccagctgactcatttttgaaagtgcgaccctccagcatcagatgtcatactgtaaggaggcagagctggcttgcaaaacaaaaaataaacctgctggcactgagggaagagaggcagattagaagttttcaaacacgtaggcagcaaaactttcaaaattaacagggaaagagaagagagggaaaaaatgaggacatgatgataggaaaataaaaatattactgcaaaaaggtaagacacaagaagaaaaacaaatctaagtcttagaagtacaatatgtaactgttacaaagttttgagatcctgaaatgggatagagtttaaatacattatcaaatgataactacatctatcttcccaatttctgttccctaagcaagagaatatgtgaactttggcatcaaaatgtttgccaccaaactgtaacatattaattactactttttacatatattaaagtaggctattaaaaaccattgataagacaagctaagtaatttaaaccaatccagtatagaagaagaaggattgaaagattattaccttaaaataaatctgtcctgggtctattaaacatagcaaagttgttctactcaaattggaaattgttttttaatcaagagaaaaatgaatatatgcagaactagcagacatttttcttgcagtaatttataatagtttctgtctgaatgaatttctactcatcctaataacagtatatttctagaatattataaataagttaccaaagtcccgaggttagaattcaaactctcaaaactatgacatatgccaggtgtggtagttcatgtctgtaatctcagcactttgggaggtcaagacataaggaccacttgagctcaggagttcaaggtcaacctgggcaacatgatgaaacctcgtctcttagccgggtgtggtggtgggtgcctttagtcccagcaacttgggaggctgaggtgggagggtcacttgagcccagaaggtcaaagttgcagtgaactgtgatcgtgccactgcactccagcctgggcgatggagtgagaccttgtcttggaaacaaacataaactatgaaatatataccacctagcaacagttcccaagcttgactttggctcctaaagagtctacttattcttttactgccaagttgctggaagtaagaatcctgtatgtgcttgtaaatgcagaacatataacctaattcaaaacatataaccaaagggaaatttttgtattaaactattgacttaggttatcctaaagtgtgtcagaataacaagtcagaaattttaaaactgaaacaataaccaaataacattggataataaaatgtaaatctcagaatgagaatcaattttaggtcttgatttgaatcgcagaaaatatgatcacaaaacacccactaatctgaatactgcagcatgagctagcaaattcaaatggtggctcacttccaataacactggtgcagcttctccatcctgcaagccactccttttacctccactgtaactctctaggagagaaaagtatactagttttattaatgttataaaaacttctagagaaatgtttagttaaaacgttcaccacataaaaggcatactttaaaatgcatattaagaaatttttaatgttttctataatgtttatagtaaaatgtttaaaaccttgaagtttttttgagaaatactttcctgtttatacatacagataggtctttgatagtggctactgatatttttaatgagaaaaaaagacactaaaatattttaaggagattaaatgaagtaggtcaactctcaggcccactattcttagcagtattcctgccaactatacattgtcttcatttttacagtatgtatttcactttacaatgacagccttttaaaggctgtaaaataattcaaaattaccttttacaagctgtggccattcggtgacatcagggtgatcacagctttgagtcactgattaaaaacaggttgtcacaccagtctagctgctaccttgatctgagcgtaggcttaataactctaataaattaaacaaacctttggttagaacactttaatatataaacccaattcattgttcaaaaaataatattcaaagcttcaaattaggtgtcaatgtaaaattcatcagaagagtaattattatagaaaagtttttaaggactattttccagcattttgtttttcttaaatgatctcttcatttgagaaaatgtaataattccttgtacttttatgtaatgttatagtttctgaagcattttggtcaatagtaccttgagtcttataacaactttggctttacctaatcaagacagataatatactaagaattaaaaaaaaaaaaaattaagcagcctccgagtgattaactgacttgcccaagattttggaactagtgttgaaggactgactaaaacccagatatactgacttcctatcaagggatggatttttttgtttgttttggcttagttttgctatactgggtttcaagatttaagtatatgtaaatgagtaaagattcagaacacagattgagatctttcaaatacggacaaattcagtcaaaagattcctaagctgatagagcaatcagtcaccaaggagggcaactgcttaatggaatagttatatacatacacataaacacacacacataaacacaaagtctagtcccactaattctgtatgtacgtaaagtcatttaacatcagtcaccgcatgttctcactcacaggtgggaactgaacaatgagaacacatggacacaggaaggggaacatcacactctggggactgttgtggggtggggggaaggggagggatagcattaggaaatatacctaatgctaaatgacgagttaatgggtgcagcacaccagcatggcacatgtatacatatgtaactaacctgcacattgtgcacatgtaccctaaaacttaaagtataataataataaaaaacatcagtcaaaaccccttaagtactgcataaaaatatattctactctttcttggccataaatctactaagatttaatttcatgaaaaagtatggcaaaagatgaaagcatatcctcctccctcaaccaaatatctttttaaccccttacatggccttagctgaacttttctgattgtcacagttcaaatttagcaggcctctttactgacactgtagttctggcaaagataccatacatctgaaatatcccagtatcaaaagatcattttgtgcaactagttctttcccctcacgattcccctatccaggccaaatctgaggcatcaactacggaaagatgaggaaattaggaggaagaaacctttcataattaacatcctcaaagcaacaatagtcaagcgtaaaaggtggttaccagtgtggattcagaacccaatataaaacagcaaggtatctgcgaataccaacggttaaaacatgaatgtttgagcccatacctatgcagctatgaacgcagggcttcaaaatccagattaggtgaggattggcctgaatatataaaaataattgcaggggattccaataaatgggatttatagtatctgtaagaaataacgcaatctcccagatactcctatcctaactatacattgcctaataagaacttagacattgctgaggtcatatgggaaacaccaccttccctaaaataaacaatgtggtcatgatacagcttccccttgggttctcaagagactaatggtatgtggaattagaagattcaaacaagtctaactttccatcttgtaaacacaaaaataataaagttaaaatatcttttaattgactaattgacctcaatgtaattaaagagctatatgtattttgaaaactagagtcaagtcctctcttccagtcccctcttttatgagatccggtgctcaaaaggctccaaggccaggctggacttatgtctctgtttggtcattcactagctgagaaatcttgggcaagttacttaacctctccgagtctcagtttccttataggtagaactaggataatagtacctattccatagagctgtcatggataaacaagctaacatctaagtatctcagaacagtgcctgacataatgtgctcacaaatggctgggcgtggtggctaacgcctgtaatcccagcactttgggaggccaaggcgggtggatcacttgaggccaggagttcgagactagcctggccaacacggtgaaaccccgtctctactaaaaatacaaaacttagccaggtgtggtggcacacgcctgtaatcccagctacctgggaggccaaggcatgagaatcacttgaacctgggagatggacgttgcagtgagtcaagaaggtgccactgcactccagcctgggcaacagagcaagactctgtctcaaaaacaacagcagcagcagcagcagcaacaacaacaacaaatgaaagctattattaatactcatagcccaaaatccaaacctgccctctcaatctttttatgcatattattttacctctcatagcacactaatctcttgtaaattttttcagcaccctacctgggtccctcatacagtcttggaagtgtagttagtgagcacctgacacaatgctttaaaaatggcaggggcccaaatttgctgaacacatctgtcattattatgacattaagatacacatgcaatacgaattccaaaaaataaaacaaaaacataccatatttcgccaaacttctgaggagctggtgaattctaaaatcaggctcttacagatttttaacctaaaatataaaacacctcactcaattctttttacataaacaactggatgaactttcaaaaaaaaaggtactaaatttcatcataaaggcaaatttattttctataattatgaacatccaaaaacgtatcaagaaacaaattactgctgttgccgggatgaggaaagcataggtaggcaggccctgtggcctgagtgctttcagcaggcaaagccatatttcccatattcatccataaagcttagtgccttctatttatttactctatcctccctccaaaagggctaaacacatatgaaaactatttgactatatccctctaatcctttcaaatacctatagcaattttgtttttaattaaattctatatgctaagcatcggctatgttaggtacaaatctgggcatctaccactttctagagtagcagccttgggccgaccctctgacccttgagtctccaatgtcaggttattgtagcagagaaaatgcgttaaaaagttatagtataatgcctacctggcacaaaacaggacttcaatatacgacgataattataatttattaaatcaaccacttaatatatatcaaaacttaactcttaaaaaaaaatcctgaagcttaaagcaagcccctaaattatcactgtaaattcttaacttgtttgtatacaatcagaacattcctcaatggaacaaaaataaagtcctttcatgtactgcattacatataaagaaagcaaatctcaaaggttaagaaacctatccagtgtcctagaggttgatggtagaaagtgaatacactgcatataaaacattttgaaataaaattaaccaacttttaaggttttagagactgactttcaaacttcagtctataatagaattacctggggaaatctaaaaatgcaactacttgggctctactcgcaaagattttcattcagtgcatgaagtaggggtaaatgaattttttttttaatttttttcagaccaacccaagaacgcagaaatgaatttgcattttaacatatacttcacatgacacacagatctcattttaagaagccctgccttccaaattatgagttaggaacacataatcatggaggaaatataccaaatctataaaaatacagaataacaaaaactgtaagcactacaaatattaggcacactcacttgccaatttaaccataagaatcctaataccagacatagttctcttactttatctcttcaacagagggctcagtctaataatcttataaataagtatagtctaataataaatgcctatgttgatctatatctacctccctaaaattttcattttattcatttctatttttccttcacctccttctaaagctgtttcaaaacttaatttcacaaactgtttttttctatcactttttattataacacccaacacttctgttctcctttgcatcatgtttatggtgtcttatatttatggataatgctacttattaaaactgtctaagttttgtccgtttacacatttcacaattaaaggactactacaacaattttcctaagtcctcctgctttagtttctccttattccagtccattctgcagttaagacttaaaaagttttaaatactgctttcaaataatacttgcaacataattccctcaactccattagctcctcagagtaccatttctttatcttctttccttttactgccaaaaagacgtgaaaaccactagctcagctgctatttttctatctactgaaatttttcttgtaaagtttccatcatttctgtatattcccagtgctttggccccttaatcctacttaatttttgtagcttttaagactgctaatgactcctcacctcctctggcttccctaatgttgtatccactcattttcttccatctctctaaaggcaataaggtcttctgctagttcatcttcctacctcatacatggcctctctccaagtttctgtcaatagccacttttcttaacctaaaccaattttctgcgcaatgtcatccattcccatagcacctctatgcttacaaacccctaactctgtatctttaagtccttatgtctggcatggtatgcctgcaactacatattaccaacggtacacatccatttggatgtctcattaacatctacattcaacgtatctaatatcaaactcaattattttcccaaagaactcactctgcctaatctcactgtcctggttaaggactaaaaaaattggtgccattcattactttctccccctcatttttatttgccctaaccactgtgtaggttgatacttgttcagccttcaaattcttcataatcattaattcaaaaactgtctactagattttgagtgcctactaggtggatgaagatgcagaggtagaaaaactagacataatttcttgccctcatgtggtgaaggaaatgggcacaaataaaaaccacaattaattatgcaataacaatgcacagttaagtgttgtgatggagagatacagggggtgttaagttgtgtactgtaataaaaagtccttagtctgaagaaaaggaaaaccattctttatgagggacaagcaagatttacaagacacactaagaaaaaccctgtgaggtaatgatggtagcactatcagtccagctgctcaaattggaagattctcagtcatattctaaagagtctctctctttcccagtatatcaaattgtttaccaattgctaccaattcatccttagaaattcccctacatttctacattctcacattattccccagtcttttttgattgcttttagttgcttccagaataaagccaaagctcccaatcacgtcagatgagattctacacaatttggtcaaaacctgccagtgcagcctcttcttacagactagaccagacttcaagagaacatgtgtatcatttgcttttatacttccagtgcttgcaaatgtttatagaataagcatcttacaaaagagaaaatttttctcttagggaactagctttcagtcctttagtaaatgcaaggttaagattcaaaccctaatttgtctgattctaaagaccacgcttattcccttgtacttgccttctaatttatactcaaaccctatgaatttccttaaaaatatctcttactccttttttcctcaaacttaccaacactgtcctactacagtgccccattatttcatctggtttcccttttgcctttatcctcaactttgccactagaattatcttcctaaaaactcaaagttacacatatcattctatattcaaaagctttaacactttctcatgccaacagaataaatttctaactccttcacattttatttgaggcccctgccatgtggccctgaccccagccatcccagcactactgcccactatatgacatcatcaccagttaccagatctagtcccatcatttgactattggctataatgtactggatatttgtgtttctgacttcaatgcttttgcttctgaggagacttcactcggaaatggtcctctatccattactaacctctatcccccacccacctatcatgccatgttaaaaactggcctcattctaaacactgtatctcacagggttatctaaactcttatacataatcaccatctccttcatgtcttattatacattcttaataccataaaataatttattaatttctccttatatttattatgttataccttacattacagctatctgtatacatttgtcagtgcctctagttgtaagctgattgatggtagggatcatctcttccatattttacttttcgtaataatggtgactatgttttcttgacaccatacctcccctctacaagaaaaaaaaaaaaaaaaaaaaggaatcaggacccatggcctttgagctagttccaaatgtgactcatagatgaacaaagataccatttcttcccaaattaacacaaatataagtaaatgccaatttaagaaacgttttttcaaagactaaatatgtaagaataaccaaaacaattgtttctaataatgttcctttctctaccagatattaaaacatattaacttaaatggaataattaaaatcggcatgcctttaaaaaactgagtatacactaaatatatgcataccttatgacttaaaaatttcactcttaagtataccaaacagaagtaaacatattcacaagaagacaatcactgaaatgtttagagcagcagcaatattcttaacagttccaaaccaaaaatgattaaatgtccgtaacagcagattaaactatggcatattcttaaaatggaatatcacttccattcttaaaatggaatatacagcgactatcataaacaattactacaaccaacaatgtgaataaatctcacaaatacattaaaagaagtcagacacaactaaatgtgcttgattctagttaaaggatgaaaacaggcaaatctaatctatgctatgagaagtcaggacagtggttacacatggaagaaaaggggtagtgacacagagcacaaggggctacgcaggagctgctgctgttttttgatctgaatgctagctaaacgggtgctcagtgtgtgaaagtgcaacaagctatacacttagaagtgtatagcttaaaacattctaaaaaaaaaaaaaaaaacctcatatggtattagcattagacaaagaggtaagcacaacaagcacaacagaaagctaatttcagagaaagatccgaaagtatctgacagttgctccttctcaaacgagaattttcagaccttggataacaggcagcagaggactataatgcatgaaaggacaaaaacaaaggaggtgagccatccactgcttggatgtctgcctggaggtaatttccaacctgcagtcaatggaggggaaatccagtgagaagacagcagttttactgagttcagaatcaagagatcagagctgagaaagctgaagtgggtaaaattgatgacaagtgccagacaagtgcttgtctgagaaggcagagaaatggcttcagaaatctgccatttgagagtccactgctgagtactaactgtacacgattaaggtaagtgactccatgaagctagtgaaagaggggcagtaagctgaaatattcccagtacttataaaggactgggagactcctaaaattctctctaacctgagtgaagagaacacggtgacactgggagcatttagtaaagactcagaaggatcatgccttaggtaggagctactaccattaaagcaaagccttctctagacaaactccaatgtagccctgaagggataaaactgaccagcaagttatttaggtggctacaaaacaaaacactctaaaagaaaacaaaatctagacacccaacaacaaaatattacaatgtccagcatccaatcttaaaaaatcattaaatatgtaaaaaacaaaaaataaaataaaataaatactaggaaaatacaacccatgaccaagagaaaaaaccaaccaacaaattcagagtgaaaaaattcaagaaatcaataagtaacctgattttcaaacagctattacaaatatgctcaagaattcaaaaaaatacatgaataaaatgaatcaaatggaatttcttgaaatataaagcgaaatatctgaaattatttaacaagggaggagaaaaaacagtaaaatagaagacaaagcaaactgaagcacagggaaataaaaagactgaaaaataatgaatatgatgttaatgacctgtggataataccaaacagtctaacatatgtgtaactggagtcccagaaaaagaggaaatgatgaaagaggagtaaaggtggtaaaaaatatatatatagaagaaacaatggcaacaatcttccaaatttaaggaaaaccataaatgtacagattcaaaaagaaaaaaaaaacaaaaccccaacaactctcagcatggtaatcattgtgcaaatatcatagaacgtacttacacaaatctagattagatggtatagcttactacagaactaggatacatggtatagcccgggtgctcctaggttataaagctgtacagcatgttactatactgaatgaatactgtaagcaactgtaacaaagtgtaagtatttatacatctaaacctagaaaaggtacagtgaaaatatggtggtataatcttaaatgactattgtcaactatgatctcgttgactgaaatgtcagcatgcggcacatgactgtataaccagacttctcatcaaaaacaaatgctgaaagaaaaacacatcaactaaccaagaaaaaagaaacatatatgtccacacagagacttctttttttacacaaatgttcattgtacctttttataatagctgggaactgaaaacagcctggaactgaaaacagcccaggtgtcccttaacagatgaagtcacaaaccaccgaaacattcaacaatatggatgaatctcaaaaacattatgttgagcaaaaagaaactttttacaacatataagtattgtatgactctacttacataaagttctgcgcaagctaaactaagatgaaaacaatctgaacaatgttaggttctaggggtggtgtggggggaaggaataactaggaagaggtgtaggttctataccctgatagaactttctggcaaaggtgtatacatttgtcacagctcatgaaatggtatatgtggtcaactgtattttccaaagatggtcacaatagaagccattccacatgctcttaacaatgtaacactgtcattttttcatcaggtggtggagtctatggcccttctccttgaatctgagtgaaattagtgagtctttcaatccaaagactacagtcatacctcaactatctacagaggactggttccaggactcccatggatcccaaaatccaaggatgcttcgaatcccttatataaaatggcatggtatttgcatataacctacatgcatcttcaaatatgttaaaccatctctagattacttataataccaaatacaatgtaatgctatgtaaacagttgttacaatgtattgtcaaagacaagctctccttgccaatccctgaccaaatgagagattcatgagcaaaataaatagttgctgatatttaaggcactaagtttggggcaatgtattacacagcaataaataactggaacagcatagtaaattctagttaaaaatactaaactactaagttttagttaacatacatgctcaagttaagggtgtggtatactaacaactgcaacttactttgaaaagcataaaaaaagacactagaagaagacaggatggatagatggacaagatagaagacaataacaaatagaacaaaatgttgtgaaattatattctacaattattttaaagtctgtgtggtttgaaaaattgtacgataaaatgaagagtgaaataaagacatttccatacaaacaaaagctgaaagattttgtagccagtagacctatactttagaaatgtttaagaaattttttcaagtaaaaggaaaataacaccagcaacaaacttggatctacaaaaaggaatctccacaaagaaaaataaataaaaatggtaaatatgaaggtaaatataaaggaatgttattcttagtttttaagtttcttcgtaagacaactggcctttgaaagaaatagtttcaaacgctgctgtggaatctataacacatatagaagtaaaatgttaagatcataataccaaaaagaatgagggagagtaaatggatgtatactattccaaaattcttacattatacattaagaggaataatatttttgaaggtagattgaggtaagttaaaggtgcatattgtaaatcctagaagtatcactggggggaaaaaaaacagagggacaagctaataatggagacaatacaaaattccaaaaatgctccattaaccgaaaagaaggcagaaaaggaagaaaagattagacaaatagaaaacaaatagtgtcttaaacacaattatattgccaactgcaataaatgtaaatggacttaatcaaaaagcaacgatcgtaaaaagtcaatctgaaagcaagatgcaactatatgctatctaaaagaaagacattaaatgaccaataagctgaaaataaaaacacagcaaaatgatataatgtgcaaaaattaatcataagaaaggaatggatacactaatatcaaagtagactttagataaggaacattaccagcgataaacagagacatttcataatgataaagacatcaattaatcaaggagatctaacagtcctaaatgtgaacacacctaaggacacaactttaaagactttgcttcaaagcatatgaagaaaaaatgaacagagcagaaggaagataaactcaaaattatagttgaagatttcaacattcctctctcggtaattagtaagtggacagaaaatcagtaaggatacagaagaaatacatttatctatctgacaaagaacatatgttctgaaaagaatgtgaaaatatttgaacagacacacaaaagaaaacttctcaacagcagtcatgaagaaaatgtaaattaagaccataatgactttttacacccattagaatggcaattattttaaataaaaaacagaaattaccaagtgttagaaaagatgcagagaaattggaacccttattcactgctggtgggaatgtaaaatggtgcagtcactgtggaaaacagtatggcagtctctaaaaaaattaaacatacaattaccacatgacccagcaattccactcctaagtacataaccaaaagaattaaaagaagggactcaaacagatacttatataccaatgttcatagcagcatcattcacatagttaaaagttacaaagagtccaaatgtccactgacaaataaataaataaaacaaaaagtgatatatgcacacaatgaaatattactcaaccttaaagaatcaaatttggatacatgctacaacatgaatgaactttgatgactgatacggtttgaatatttgtcctgcccaaatctcatgttaaaatataatccccaatgttgggggtggggcctggtgggaggtaactgggtcatgggagcaatccctcatagcttggtgctctccttgggatacagagtgagttcgcagatgtggtcgtttaaaaagggtgtgccacttccccaccctctctcttgctcctgctctcgccatatgacacgcctgctccccctttgccttccaccatgagtaaactcaccatgagggctccccagaagctgagcagatggtggcgccatgcttgtacagcctgcagcaccaggggccaaataaacttcttttctttttaaattacccagtctcagatattcatttaaggcaacgcaagaatggcctaacgcaaggacattattattattaaatgaaatgtgccagacacaaaaggacaaaaatcgtatgattccacttatatgaagtacctggaagagtcaaattcacatatgaagtagaacagtgattaccagcagatagggagagtaggcaatgaagagttactgtttaatggatagggtttcagactgagaagatgaaaaagtttcagagatggatagtggtgatggctgcagaataatgtgaatgtactttatgtcactgaactgtacacttaaaaatagttaaaatggtatatttgatgttgtgtattttagtaccacttaaaaaaaaacactgcaatgggataccactacacacctctcagaacgtgtgcaattaaagactgagaacatcaaatgctgacatttggagaactggaactctcatacactgatgatgggaatgtaaagtagtataatcatctggaaaatagtttggcagttccttatacatttaaacataaacttaccatgtgacccagtaattccaatttaaggtatttaccctagaaaaatgaaaacatatgttcacacaaaaacatgcacacaaaacagtacctttattcgcaacagcctaaaactgaaaacaatttaaatgttcaccagaaaatgaatgaactgtggtatagtcatattgtatttaaaaaaacgaaacaaacaaaaatctgtgacaaacacaaattggatgaatctcaaaaacatgccaagtgaaagaaaccaggcatggaagagtacatgttacttgattccatggatatgcaattctagagtaggaaaactaataaacagatcagtggttgcctggggccaagagggagaaatgactacagacaggaaggaactttttggaggtaattcaattgttctaaagcttgattgtagtagcagtgatagtgtatatatttatcaaaatcaataaaactatatagttaaaatgggtgcatttcattgtgtatcaattatacatcaataaacttgatttttttcaaagtttgtgagaacttaatatagaaaaaggtggcattatcagtggggaaaggatgccttacaagacaatcagctacccaagtggaagaaaataaaaggtagatataattcccaaaccatgacaaatgcaatccagatctaaaccatatcataccatatccaaaaatatgctgaatgctcatatctaactttctaaattaaagtctataaagtaaaatcacaaaagtatcagaagaaaatacaagagattggccaggtatagtagctcatgcctgtaatcccagcactttgggaggctgaggtgggaggatagcttgaggccagaagtttgagaccagtctgggcaacacactgagatacgttctctaccaaaaaaaaaaaaaaaaaccaaccaaccaaaaaaaaaccaactagctatagtggcacatgtctataatcttagctacttgggaagctgaggcaggaggatcacttgagcccaggagtttgaggttgcagggagctatggttgctccagcccgggtgacagagtgagatcctatctctaaaaagtttttgtaatatatatatgagatcatatttatatcaactttgttagcatgctgaaacccagaaaccataaaagatggacagatttgcctacataaaaactttaaaatttcacatgactagatactataaaattaaaggtaggtagagataatatttgcaaattataataaagaattaaatgatatataaagaatgcttacaaatttaaaaaacaaacaccacaatagaaatggaccaaaaaaccaggcaatttcccaggttatttataaagacttaaacagattttatatatacatgaatcaaaacaaggtaaatgagcagtccctaatatattttaaggaatgaaacttgctaaaattattttttaaaaggtaattggcaaaacctatcaaatatttagattgacatgatctaatggcctgacatcttatttgtaggaatctaccttacagaaaaaataacaggtaccatcattgcaaaagcaaatattgaaaacaaccgaatttccaaaacaggcaaagggtctcataacatcatgaactctcagagttaattcctagttcagttctaaagattgagagaacacatcagatttagagtattccatctcaggtttctcaaggacaatttttcattaaggcctaatttattatattttaaaacatgcttttccatccttttttctgtttttcctcttttccccccacaagcttatatggtaaaattacctgtagttaagtgggcatgtgatatgatgcacagatttaatgcaataatttataagaattatccaactccattctctcagctgctctggtcaaaaaactttggcatcatgttttactcctccctttatttcccactttcatctggtctactaccaaatcctatggactctatttcaacatatatcaagaattcaaccacttctcaccaccctcactgtgaccactctgtccatttcagtcacgtcttaatctgtactaatggtctaccaattggtctgtttctgcccttgtcccctttttcagtctatgattaacacagcaaccagagtgaccttgctaaacataagtcatactttttcactactctgctcaaagacttccaatagcttcccatctcacttataggtaaaaatcaaacaccttattatgatcaaaatatctgtaccctccattctctctatttcccatcaattacttttctaaagctacactggccacacctcgagttcttcaaacacatcaggcactctcactttggggtttccctattcactacactctgcctgaaatgctcttcccccaaatatccacatggctagctctctcatctccctcagttcttcacccaagttaccatttcagtgaagttttctctacctaccctatctaaaatttcccatcatccttttcacctgcaaacacttcccttatttgtttcttctccttagcactatgtaacatatattttacctatctttatgatctctttttaggatttaagtgccatgaaagcaaaggactgagtgggttttatacactgctgtctctaccaggacctagaaaaaaaggcccactacacagtaggtgttcaagaaatgtttactaagtgaatcagatggatgtgtatgtagccaaccatttgaaagattcctataacacagttaagaggaaaaaaaaattatatgaaacacaagttttagtacacaaaaatctatgcacaaggaattaaaaacctgaaatgaaattttaaaaaattcaatttgcaataccatcaaaacataaaattcttagaaataaatttttaaagtaataagtacaagacctgtatactgaaaactacaaaacatgaaagaaattaaagaacaccttaataaatggaaagatatcccatgctcatgaatgagaagacagtattaaggtagcaatacttcccaaatagacctacagattcaacacaaatccaagtcctattaaaatcccagttgcatttttttgcaagctaaccctaaaattctatggaaatttgagaaacccagagacccaaaacaattttgaaaaagaataagttagaatactcacatttcctggtttcaagacttactacaaagctacagtaatcaagagtgtgtgttacccaaaaaaaacagacatacatgtcaatgaacataccttgaaaataccatggtaagtaaaagaacccacacacaaaaggacacatactgtatgattcccatttatatgaaatatccagaataaataaattcatagagacaaagcagattagtggtttccagaggccaggaaagaatggggaatggctgctaacaggttaggatttattttggggatgatgaaaatgttctaaaattcaatagtggtgatggctgcagaactgtgaatatactaaaaactttaaaagggtgaattttatagtatgtgaattatctcaataaagctattaacagttttgaaagttagagaatatgtttggtaggattttttttaaatactgcctccccaaaaggaaaaaagctgtatgtatatcagtacttttacagctatcttacattttatatttgattggtaatttccttccaggcatttttttccctctacagttaaacacacttaacaactgttaagttttagaattggctatgaagcgaagagaaacctttcatttcttcttatacttaaaaaaaaatagctttttatttttcttttctgtatttcctcatcctcaaaaatagattctacacaccaatatttgagggatggtggggcaactaccacaaaatacaagaggctctcttctggaaatgtaaaaatgttagaattcctaggaacttttcatgatttatgagcctaacctaacatttaaaactgagcccatgctggtaaatctgggctacacagtcatacatacatagaactctggaatcacaacacatccactgtgcactggaagagtactgtaatctccttctaatgtgcaccttggctctcccctcccttgggttctttgaaattttttttttaaataaggtatgtttatttcttatttacctactaactacagaaggtagactcacaatgtgccaatattaaaatgttatcattcctcattaaaatatttacttaagtgttttattacatgacttaccagcaatggaagaatctcatctgagagtagttctcaactgtcatctatgaaaatctttagaaataccaaatcatcagaattactttaatttcctggcttttaatcataaagcattcctactggtcaacaattctacaatctgaaaacagggacatctgtaccatatagtcccaatgatttattattctgaaattttcctctgggttatttttacactgtaattagagttcaaacttccatagcgcctagcctaaaattaaacccagaattatgccaatttatgcctgctatatatgcacacacaaaagacttataatgcaatatactaaaagaactaaaggtaggtgggtttttccttgaaggaatcatagctacattattttcaagtttaatctgttacattcacctgcctatcaaataaatgtagcacttaaacgcataaaacaaaatttgatttagtgacaaaaaaccattagcttctaatttaacttcaaaacgcttttcaaaaaatctaccccatctaattctaagtgaaccagaccacacttgatagaaaactgttgttctaaaaaccatacgtacttaacacaaacagtaaacatatgagaacatttagtcttctattaatgtcttacaaaatatttcaatgtggctggttataatttttttttttttaagggacagggtctgtcaccgcggctggagtgcagtggtgtgataacaactcactgcagcctggaactccagggttcaagcaatccccccacctcagcctcccaagctgggctaattttatttttcatagggataaggtctcactttgttgcccaggctggtctccaattcgtggcctcaagtgactctctcacctctgccttatatttccgtttgagctgttattatcaactggagtaacatttctagttggggaaaaaagaactgatccttatctgtagatgaacacttatacattcagcacttacaaataactgaatgtgggcatgaaaaaaagaatgacagatgataaacatttactgttctcaaaataaattacctaatctcagttgagataaacacgactcagaattcaattaacagtataatataaagaagccccaaaccaatgagtgcaaaaagaaagactctcaaggaaggcttccctgagtaatatttaggttgagccctataagatagaaggaagatggataactcaagaaactaaaagcagcctgtgtggtaagatggtactgaccaaaggggaatgcacaggaaggtaaggctcagaaagtagacagaaccctatcaaagcaaaattttaaatagaaagcactcttctatttcaaaataactgttatttgttcacaataatacaaaggaattataaactactaaaactaacaaaccaaagtgggcaacataggaagaccccatctctacaaaaaaaaaaaaaaaaaaaaaaaaaaaaacccacaaaacttagcagggcctggaggtgcctgcctgcagtcccagctacttgggaggctgaggcaagactatcgcttgaggccagggggttcaaggatgcagggagctatgatcatggcactgcactccagcctggggaagagagggagaccctgtctcctggaaaaaaaaaaaaaaaaaaaaaggtgggtggggtggggagaattcaataattaggacgaatagactttaaaatgtagtttatacacacagtggaatactactcagctataaaaataagaataaaaccctgtaatttgcaggaacacggatggaacaagaagccattatgttaagtgaaataagccaaacacagaaagacaaataccacatgttctcactcatacatgggctaaaaaagtatatctcaagaagataagcatagactggtggttactagcagccgaagtggggagtgagaggacaaaggcagaagaacataactgtatttattattgctgaactgtacacttaaaaaactgtacacttaaaaaatcattaaaaatgaactgtacacttaaaaaagatggtaaattatgtatgtatatttaacctcaatacaaaattttaaaaattcaatacttaatgctggaacaactagcttttcatatttaaaataaaaaatcctaactcctttcagatgaacctaaatgcaaataacaaagagtaacaaaaaatcctcaactattagcagacaatataaaaagaggatttcttaaacaaaaagcacaatcataaagaaaaagacatgatttttacatcaaaaattaaggctcatactaccagagaatactacaatgggcaggattttatattttactcttattctggtaactttctttggctgcactgtaaagtaagaaggttggatgaaatgatcttcatggtccttttcaacataaatgttgtacgatagtgtgcctttcctttaaaaacatttatttttgagatatttaaaacatacagaaaataataaatttcctatccttttacctacgattcagaataatcaagcaactgtaaattaaaatgagatagcatttcacatgcctcaaattagtaactattttaaaatctgacaatcccaagtatgggtgaggatgctagaaatgcccacataatgctgataaagtatacatgggcatatccatttaggaaaagaatttaccaatatctagtaaccagcaatttcacttctacggtttttcccaaaacacctgcacatacactcatgtaaaaataaacactgcagcattatttataatagcaaaaagaaaacaactcaaaatatccatcaatagtgggacacatacattttatctatgcataaaatgaagtgccatacagcagtgaaactgaataaactacatgtacacgcatcaacatatacacctcaaaaacttgatactgagtttaaaaaaatcaagctattgaaagacagcgttatacatgtctgtaaaaatttaatacaaaaaccaacaccacatatcacttacagatacatgtacacatgtatagtaaaagtataaaacaaggatgtgaaatttacttaagaatctcaagacagttgttactttgtgtagagacgggtaacaggacttgaacagttggggttgttaaaagtgattatataactgcatcctttcccccaagggataaaaatggacataatttatatttccaggtggtggataaataggcacttgctatgtcattttctggatgttttaaaaattttacaattaaaacatatacacttattttaaaaacaaacaaaagacatattagcatataatgtccaagctgataattaccttggaagattatctaatataaacctccctacttcactaaaaacaaaattacaaaagatatcagaataaaaatatgatacaggctggacgcagtggctcatgtctataatcccagcactttgggacgccaaggcaggaggatcacttgagcccaggagtcaagaccaggctgggtaatatagtgaaacttcatctctacaaaaacaaacaaacaaacatttttttaagaatgtaataggattggtgtggtggctcatgcctgtaatcccagtgctttcagaggttgaggcaggcagatcacctgaggttaggagtttgaaaccagcatggccaacatggtgaaaccctgtatctactaaaaatacaaaaattagccgggcgtggtagtgcacacctgtagtctctgctactcaggaggctgaggcaggagaatcacttgaacccaggaggcggaggctgcagtgagctaagactgcaccattgcacaccagcctgggcaacagggcgagactacatctcaggaggaaaaacaaaaaaaaacctatatatatatatatatatatatttatatgtattatatatatataatacatatatataagattatatatatattatatatataatacatatatataagattatatatatattatatatataatacatatatataagattatatatatattatatatataatacatatatataagattatatatatattatatatataatacatatatataagattatatatatattatatatataatacatatataagattatatatataatatatataatacatatatataagattatatatatattatatatataatacatatatataagataaatactattgtagcagggcaattttggacaaatactaggttatctgaaacagcactttggggaattagatcttgaccatttaagagagagattagccccagtttctcaaaatctggcactgactagcaatatggacaatgtgtgcaccgccctcgttccacctcccctcctaggaatgccatgtcaaattcagcacaggcataggcagtaaaactgacccctagttctgcctatcactatttaaaattactttaagtgttgaggactgtccccacagcagatatctaaaagtaggcctgaaagaactagaaagtagttcatgcatccagcagttacaagtgcctaaaactgtacatgaaaaaacaaaacaaagaaatgaactgagagcaaacatttactgttttcttataatcttcaatccaggatttaagaaattatttaatatcagttgagatacgtgaccaacccattctccagctgagatccatctatttttaaattcactcccccagcctttcattcagcctaaaagagggaataagaatgggaaggtgggaaggacttatcccatactgagttaaataagaccacaagatcttttcatttttacaatatttgaaatacagtacactgagcaataaatttaaagaaatatgcatgatttgaaatgcagaaatcttgatttatgtgtataaaagaccaaaattagctcagttcgtctaatacactacacttaagtgttcttcaatactacagtcaacttttcagaaatattcccattctgtgaagcaggatgtattcctaccttgattaccaaactttatccacgtaacttcctattctcccactctgttctttaaacatgttcaacatgttacagagatggcaaaatgtgttacaaaagggaatgagaatgaagcagcttaagtaattaggaaaactttacacttcttagaaactgaatttgaatgatcttaaacagcatattttcttttcttttcttttcttttttgagatgaaatcttgcttgcccaggctggagtgcaatggtgtgatctcagctcactgcaacctctgcctcccaggttcaagcgattctcgtgcctcagcctcccaagtaactgggattacagacgtgtgccaccacgcctagctaatttttgtatttttagtagagacagggtttcaccatgttggccaggctggtctcgaactcctgacctcaggtgatccgtgtgcctcggcctcccaaagtgctgggattacaggagtgagccaaggcgcccagcctaaacagcatattttcaatcaccaacacacaacatgaccactgacttcagaaaactaggaaagaaaaatgttacccaattaatctttgtgtgaaacaggatttatccattagtatacgtatcacataccatagatgcacaaaagattttttcaattcccaaaacaaaaacttaaaatatttagcaaagataatataaaaatccttatttatggcacgctgtaagattatcaatattggtgcatataaccacagaggcacaatagaattcttaggaaaaatgtattaagacaattaacaagctggaaataacccatatttccccttatgacccattagctttatatagaaaacactgctgtgcacttcatcctttgctttctaaagaacagcattatggttcacatctgttaagagacaaaaaagtatttgttggaagtacgaaaggaagaaattcctgtactgttacatgcagtgccaaaggaatcatctgagaagaaaataaagaacatgagtttaacatgagctttagagagggattacaagagtgcaagaaagtgacaaaatgtgacatatgtccatagtgaatacatggtgctttattgttttcagtatttctatatttaattaggaggtggaaagtttcagaatttattctgcatcacaaagattataaaaatatatgagttggggtgttggctacagtacacaaaggcaattctaagactacttattaacagaagcttgaaatggaaaagccatcccttctgatttcattacatgaaaagaacctgtgtagaagtacagcaatggtagcatcttcattcagcccacagctatgtaatttgtatgcaagagtgcttgtcttaaatatgaaaaggaacatcctgaattgctgaaagtatatacaacgggcacacatccagaactaggaaagagctaccaagcctgcatgctacgaagacatgggtcaaaaaatttttctcatgtttggtttctataactaaagtctgtgctagactaacctcaattgatcctgaggagatgaacttctggaacacacaaaactgttaagagtcacagcattagactctacactgtccagccaacagttttaagaaaaattttatcctacttgtatgagtgttcagggctcatatactacctctatgctcttacttgaaacacagatgcagaccttaataaataaagtcttacatcagactctcttctataattcacatgtgattccttacacgagattcctgttcagatttcctgaaaatgaactataggaataatcttatccaatatgattctatgtcccctaaaaatatcttttcctttcaggtcaatcttatgattcacttgccattgatcagattaacacaacaggtctggtacagcaaattacaaaagagatttgacttttgattaatacactgaataatgtatcacaaactattaagatccattgtccatgtcaaatggagttcacatatttaaaatgaattcacacactaaaaattccccaaaacaacgtttctaaaaagtttttttttttttctttgagaggcagtctcactctgtcgccaggcagtagcatgatcttggctcactgcaacctccgcctcccgtgttcaagcgtttcccctgcctcagcctcctgagtagttgggactacaggcatgcgccaccacgtccggctaattttttttttgtattttagtagagatgaggtttcaccgtgttggccaggatggtctcgatctcctgatctcgtgatccgcccgcctcggcttcccaaagtgctgggatgacaggcgtgagccatggcacttggcctctaaaaagctcttaatctacattttcaagaatgatcacgtttgaaaagcatactcttttaaaacaaagcaactatcactttcatttgacaaaagaaggaacgaaggcttcaaaagctaaataacctgctcatgaccattacgaagctagttaaaacaacctcaagaccaaaagacagtgctcattccatttcaatgactctgatgcacttaaaattttataaataatttttagggatatcagtcataaggcttagaatcaaatagtaacgactcatgtacaaagaccagtattttttaaaaatgctcagctgggcatggtagctcacacctgtaatcctagcaccttgggaggccaagccgcttgagaccaggagtttgaaaccaacctgaacacggcaagaccccatctccacaaaaaaattaaaaaataaaaaaattagccaggcatggtggcatatgctaatcccacctactcaggagggtgagatgggaggatcactccagcctgagactgcaatgagttatgacagcaccactgcactccaacttgggcaacacagcgagaccctgtctctaaacaaataaacaataagtaaaataaacaaaaagaaaatgctaactttacttcactctcagataggcctaataattaataagcttctttttgaattattatccataatggcatttacctgttattgataactcagatcaaagcactactaagcaacatttttgatagcaaatgaaaacaaaagctggcaaagaaactgtgtattaataagtcatttgattaaaaaaaaggacttggccaggtattgtggctcatgcctgtaatcccaacacactgggaagctaaagtaaaagctgaggagttcaagaccagcctgggcaacacagtgagacccccatctctataaaacaaaaatttttaatattatctttttacaaaggacttatttatatggcatcttcaagtatttcaaacatttcgtgtttggattatggaatatgtctccagaagaattaacactatttctatttaaggtaattttacatcatttcctttattagaagaaataacagatctgcagatggcattttgtgaaggctgccttctattaatagtgtacaaaacactcatatgtctccaaaaaggtgggtgagtaatcacaaagcaagtataactattcatcccaaaaggtaggacagaacatgtgccaatgtgtgcagagtcctgaactagagacatggactctggttctggttctgacacctgggtgactttaagaaaatcattttaaagctttgcactccaatttcctcttgtataaaatgactggagcagctgacctcatagacaatcctactcaggtagcatctatccatgtactgccagaagacagaatgataatcatgccccccaaaattagagtatttgaagacaactgccggagtaaaaattttaaattctatatacatacacacacacacacacacacacacacacacacacacacacacacacacacaaatactaatacactacgtgccagatactggggtggtgggctgggaccaaggaatgaagtaatgcatgtgccagagggttgaactttttaaaaggagtaaaaaagtaaatctttacagtagcagctggtgggtaggaggtattgagtccatagaactgctcttagattggaagggcatgggaaaatgaagttccattatgtgatagggttttacacacacacacacacacacacacacacaaatgtgagaaagtcactcaactataagcattcaaaaaagacagacatctttcttgtctttgtgggtcctgtacttagctcagctcatagaagccacaggaggaacctaataaatgttagttgatcatttactgatttaccaataaccaattcatgcctgctctagtgctgtggtctgaatgtgtcccccaaaattcatgttgaaagcctaacctccaaggtgatagtattaagaggtggggcctttgggaagctttgccatcattaatggaattaatgcctctataaaagaggccctatagagccccgtctactcttctactacatgaggtaatggtgaaaagacagctagctatctatgaacaagggaagagggccctcactaagatgtcaaatttgttggtaccttgatcttggacttctcagcccccagaaccgtgagaaataaacttctgttgtttataagccatgctgtctgtggtgttttgtaatagcagccagaacagactaagacatctagtaacacattctctggtaaacactaggaattcctggccttaaaaagttcatagctaatgagaaaagaaataaacaacataaaggataacatgctgtagtccactacatacaaggtgcttccagaccattcagaaaaactggataggaagatttctaaggtaatacttattgagtgcctacgtgttaggcgttttacatactttaagcctcacaactctggggaagtttcaccaacccattttacagatgacaaaactgtggcttaccaagattaataaggccagaattaaaattagggtctaattccaaagatattaccactatacataccaagatgtcttgttactacattttatccttacatttggcagtgaggggaaaactcaaaaagcagtcaaaaaacttttgtcctgaaccaacataaaaagagcacctaagacttcatccagtattttaccgaaagatcacttctaaaagtttgtcttcaccccgatctaaaaattagaaaactaattttctttcagcagctgcatatgtacataatgtaatgtttctacatttagacctacacaattataagtctaaacaaaatatgtgtaacatgattggagaacataactagcagtcatttaagaaaatggacatttggaaacatcatttcaagagcttgggatgaaaaattttgctatgacctataaatctggatcattccactgactgacactgagagaaacagtgtattatcacagtttacacagtaaatttttttggaggggagagggaggagattgaaatagaaatgatcgaaatagaaattatctaaagtttaagaaatacaactgattaaatgttacatgtcaaagacactgtaggtacccaataaatcctgttaaatggactgcacaagtgggatgagaacacgttttccccacacctctgactagtatgtacctttcttaggaagttattttttcagccatgggaaaaaaaagggcagaatttaggacagataaaacataagtagcttataaatcctctgaaaggaaatcaaaacacagtattttgtatctctgtataaagttaagctcctcagggacaggggcaatgtccagaggatagtgagcatactacttagcaaactaatgcaggttaataaatattgacacagtaagactagcatagtttacattctaattttgtaaagattataagttacctcttcatattctgttcttttatttctcctgtgtatattataaatacacaaagattgaaaattatttcttgaagctatttccttttttattttttggtcaactgtattagtgtttcttaaaagggcttctggtcatccttagggcttatcagtagcatcattaataatgtattcatttcactaaaaatgtggtaagtagcttggatttaaaaacaggatctaatttcaaagctatttccactatacacaccaagttacaactttcttatctctcctaaattctaaattttacatgatttaccaaatcacttcttaagtaagagtacttattgatcagaagtgtgagacaaacaccttatcccacttgtccaatttattcaacaagattgattgggtacctttgtgtctctgacaggtaactttcaacagttgtatttcttaaactttaggtcgtctcccaaaaaaaactgtaataatttgctgcttctctcaatattgcaggcagtaaaatgatccaaaattacgggtcatatccacatttcttcatgattgaggttaactgtgcactgtaaaccccatatgctattagtttacattttcaacagcaccctcgccacttaataatctcaaacagattttggactgttactaatttagcatatccataaaaagtcatttaaaaaatgtagacgctaaattctctttcaaggttgccaagcttcaccagtgtctgtattaaaattatttctaaaattttacggactaaggcatttggtacattcaattctacctttaccaacaaaagcctttaccaccaagatgaggaaagcatccttttcattttctacactgaaaaggggggggaaaaaaggccaactgcttgcatacaggtctgcatataacacagcagtctctggcaaagccaataactcacgttcaacttcagaaatcctggtggccggtaacacagagtaacctgtgcgcacaacccttgggcttgacataccacttcatccgccctcccttcccatcaatccacccccaaaaccccaacccaccaagcacacggctaaatatgtcttccccaagagagccaaaaaccttgaaaacgccgagaaagggctcccctttgaaggaaagggcctgcccttccctgtctggggccccggctggctcgaagagcctggctcctaggaggcccaaatctcgacgcctcgcacgtcccgccccgccccgggcccgctcgcgtcccctcgggcgacaaaaccctcccgccgtcgctcagccaggactgacagttacggctgcagcagccgcggccaccaggggcctacttctggcaccagccccttcggaccacgcgcccccaaacactcgcctcggcggcggggggcggggaaggggggtgtcgacctcgccacagcgggccccgaaggccggccgagtgacggaggggagccagcgccgcctggcgcaggccgcggcaacactgacctgtcgtcgcccccgcgcctgggctgcggcggccgcctcactggtcgtagtcgccctcgcccgccgcctccgcccgccaccgcctcgttctctttcgctgccgccaccgccggggctcatgcgggacccgcgcttccttatccggaaaacgaggccgggaaagggagcgccggggccgccgaaatcccggcgttcgtcgccagccgccgctgcctgtccacaccggggggctgaggggccctcctgccaggggctacaggccgcgagctattccgaggaggagccgaaggaggcgccgccgcccgcagccgagcgcgccgggtcggcagaggtgaagcgtaagtaggcggcggatggcgggcgcccgcgctggcggatggctacgcggcggaggggtgcgcgagcgagcgaagcctggtgtgtcgggtcctggcgaagggaaaaggccccgtcgtctcctgtagtcaccccgagcccagcgccaccatcttgggagacacacggatctcgcggccgcggcgcaagacgggaggactggct

SEQ ID NO: 5 - DNA, 77978 bp, Mus musculus
ctgtcgggatactcggtccgcccacctagtcctctcgtccagtgctgcgttcgcgagatccgtatttctcccaagatggtggcgctcctctttgggtgactccaggagacgacagggcctttcgtctttgccagcacctcgtcgcccctcctgcgctcgctctctcgctcgcgcaccgggccacgcagctgttcaccgcctcgttacgcttctcttccgtcgacctgtcgctgacggtggcgcctccttctgcttctcttcggagttgctcgccgccctcgccccccactgtggacagatcgcgacagcagcgcttcagcgccgacttcaaggttgcccaggcgcctggcctctcggcctcggtttcctgaggagaagcgcgggtcccgcatgagacccggcggtggcgccagcgaaagggaacgaggcggtggcgggcggcggcggtggacgagggcgacaaggaccagtgaggcggccgcagctgcgagggccgcagcccacgcgcgggggcgaggacaggtcagtgctgctgcggctgcggcctgcccggcgcgctccctctggtctgtaccgccggtcccctcgtcaccctccggcccgcgctgacagggtaggcgccgggccctcacccgcctccgtgagcgagtgcttggggcgcgtggtctggaggggccggtgccaggactaggccctggtggctgcggctgctgcagccttaactgtcagtgctggctggacgcaggagggagggttttgtcacccacgggtacccgagtgggcccggggtggggcggacgtgcagggcgtcgagatcgggggcctcatctaagcagagatcggagagccagccgtggcttcaggctgcgaaaggcaggccttttcctccaaaggggcgctctggtggggaagacatatttagatgtgtgcttagtgggttggggtattgggggtggattggaaggaagacggatgaagcggcacctcaagcccaaggattgcgctctggttttattcgtgtgctgcttctggtaggattcagtagttgaacgtgagttactgattcctcagaaactgctgtgttaattttcaatgcaaacctgtaagcagttggcctcctcctcttctcccctcccccttttcagttgagaaaatgaaaaggacgttttccccattttgatgcggaggctttttgttggaagaatcagagttgaatgtgctataattgcgttagccttaaaaatagaaagtataattttaataagactttatcagctttagaagaatcctctaaagacaattttacgtcaattttttttatgtcttttgagcatgctaaaatagaacagtataaaatctctttgggattgcgttaaatagctagtgtactgttggaaatgttaactaaatagtatatgggatgtgttatccaccattatcttacttcgtgaaggatattcgtataacccatggttttgggagaagcagcagattatgttaaaatgttttggatagggaagtgcgtttgaaataaagatggcctgaactttaagaaatacagctgttaaaaagctaaatatcaaagccctattggacaagagacacgacgaatgtttttgacacacctcagattagttaatactcttaagatatctttttggtaaattatgtaaatttagaattgaggagagataaaaggaaaattttgtcttgttatgtatgacagaaattgctttagtattaaattctcctcttaaatagactgcttactgcacttttaaggaagtggatactgcatctgtattgctgataagcctaagtaaggatgactgtaaatccataaatacttagctttacaaaaaagccatgtatcagaatctgtaataaaaatgagaacttcaacaattcgcagtctatcgtttaagaaagatacagcacataataaagatgagatgacttgtagttttgttttcaaaatcagaatgtaggttgtgaaataatttgtgtcaatatttaccttgcatggtgtgttgtgaagtggtatacacatacttctttggatgttgctcttcatataactgaggagcttaactttgagtttagaaaattccttttgtatgcaggttttgtaggtggcttttttatccctgaaatagccaccatcacccttttttttttttttttttgagaaagggtcttatggtatatcgctggatgacgtctaactctcctcttggctttgtctccagggttctgcgattaaaaatgtataccaccaggaccggctatttaccctttttatggttttaaattagaaaaatgtgatttctacctgagacaaaactcattctatttgattcgtttttttttttttttttttaacattgcattcattaggtatctataatgtctctgacatgtaaattttattcagttgtatttcttaaacatttgtgtcttccctcaaataattgcagtaataattgtttctctcaatttttatgaacattttctttttaattggccatagctatttttttttctgttcaagagcttaagatgatcttttcaaatgtcctttaaaaaaaccaacaccttaaatgaatggttactggtatattatcatttattctaattaggtttgtttgttattattgataatattactgttaatggatttatattatatttatatgcagctattaaaaacatcagtgttctgatttttgcaactggagatgagttttaagaggtggtcttttaagtactttcaaatacggaaaaacaatataaaaatataaaaatagtcctctaagtcttttgatgttctcttcagaaaggcttaggataatagagttttggttttgacagttactttttcttactgataaaaataaagacaatgttatgttaggcatgatgtctcacatctgtaaaccaacaattgagaggctaaggaaggattgtggcaagcctagactaagaggcgagaccttgtctcaaaaaagttatcaatcagagatgtcatagaatgtgtaattgaaaacttttttctttaattaattaattaattaatatttttgggaggcagggtttctttgtgtagccatggctgtcctggagctagctgtattgaccaggctggcctcagactatgtttccagaatccttaagtctgtttggcctatttataaaataccaaagactggtcaacaccccccttccccccaactccaaaaaatgtatctcacagtcaaggacactgagaaatcttaagatcagaactaattttcattgtaaatttgagtagtgttaggaggactaaggactgaacctagggcctctcaagttctaggaactgctctaccacttcctagtcctctgtacacactccagctcagaccttgaaatgggagtcctgccgccttccataggagctgtgattgcaggccagtatcactatgtctctgtatctctgtctctgtttattagggtttttgtttgtttgtttttgtttgttctttttttgattttattatatgagagtccacattggtgtggtgtctgtaggggtgagaagagagtgttggaactgctgtgactgggatatagacagttgttaattgccatgtgggctctagaaattgaacccaggtcctctggaagagcaacaagtgcttttaatttaacttttgaatcatctctccagccttccctatatttccctccccttcctttcttttttcttttgtctttttcccctccccgcttccctttcttgtgtcagtgtctctcactagcctctgaagctaggtaaatagtcgaagctggcctctaactcaaagatccacctgcttcagctaagactaaatggtcttttaaaattaggacattgctctcattcatcaatgtaggtcctcctaaaaattacacttgtaatttcatcacctccgattttaggcttttagtgaagtttttttttgggggggtgcaaagattcagatcacatagaagaatatgtctgaaatagttatcagtatcaggtagtgtttctgaggctcctttgaattgtgtgagctgacatgggttataagggttaaaaaaaaagaaaatatctatcatttggaaactgataggttggttatttattgcacataacaccattttattttttaatgtgataattctgttaagttatggaatttaattgtctgtgcccctccagttttagggcagttctgtagacttaatatcccttaaccccttagctacaattgtaaaggatactgtttgtatccttttttgtatccttggtatatgtgttcatgtcttacttgcagcccatcaatatccttttacagtacacatgcacatgtggtatatataaaatgaaatagatttagtctagtatgctactcagcctgttaggactcatttatttggacaatgattaccattctgattcaataataagagtcagagatgtttgtttggaagaatagctacacttattttgcaattagcaattcacttttatggagttatatatttttatactattagtaaaatataatccttataagatagcacaggatttaattcttttaaataaaagatgtgaaataaattgtattaagtagaaatattattatttttctcaatttctttttccaaccatgaaaggcttgaaatacatgacacttattccttcttaataaagtgacttattaatgtacacatcagatttcctttgttttcatttaatttcaaaatattacctatactttcttgatttcagttgtctataacaactaaactaatgaatagtaatttggaaagattataagtattgggcctatctatacatgaaaaaaattttttatactgatttttgaaagaggtttcaatatacattacttattacttttaggttttacctgaagccacagaataagtaaatggctcagaatttcagtggtttaggaaacaaaacaacttaggattattgaaatggaataaagaatgcaatattcatgttgtcagaagttgctgctttcctgacatctgtcttgagccagagtgagctaaataggagcaggccatttatctttctaaggccttgttaatcatattaaagtggtactgccttcttgttacagaggattatgctgctcatatgtgatacttcttgaacattgatagatactgtataaagaaagtaacttgcccaggaaatttgtaggagaaaggatgatggaatacggttatattgttttctgttaacatggctaagcctcctggtctttctggtatgtacctcttttgagagctgggattgcaggggtatatctcctttacagccgcaattacaatatatgaattagtttcagatttgataactatttcaataagcttaggttgttttgtttcctaaaccactgaagttctgaagcacttattacttctgtggcttcaggtaaaacctagaaataagtaatgtacatttaacatgaaattgttagtgataagttatttgcaaagctgaattccttgtcatttgctcttcttgacctgatttttaattaaatgaattgcaagtgaatcagttataagaatgatgggaaagggtagcctttaggggccatagtaccatagttaagcttattcttgcagttcagttgtagcaaatctgaggagaagcctcacgaagaaattgcattaggcttatgaaggagaatcctatgtaaatcttgctgaagctggcatccttatttgagtgaaaccagagtagtagtagtagtagtatataggtactgaactttttatatgagcaggataaaattttccttacacataaccttgtgtgtaatctgttgttactcttagcagcagctcagtacatttcagaatttggtctttcttacctgtcaacatcatttaagcagtatagcacaactctcattaatttgacagaaatcagatattaaaaaaaatccttcaattttagttttacatagctggggatagaatacagggccttgctacctagcagtgagctacatcactaggttgaaaaaaatactttgaaaaaaatatgttatggagccttagaaatctagtttgaatggtgatggggtatgtgtgtgggtgtgtgcgtggatggatggtggtagctgtggcggcagtggtggtggtggcggcggaggtggcggcggagtagtagtagttgataaaaatcatggtatgtaacctaggatagactgtatctggacatgtagtgcagactgcccttgaattcttggtcttcggcccaagtgctgagacactttttagttcttgtttgttttatatgtttttttaaaagacagaatatcttgtagtccacactggtctcaatttcttagtagttgaagataacctcacctacttatccttctgattacactgctccagtgctggggactatgggtgtgaaccaattttttttgtgtgtgtgtggtgtccaatgcatatatcttcaattcagaatgttcttctggacatttaaagcaagcagtttggcacacaaattacatagctatgacatgaatgaagatactgtcagtgttgtacttttctgaacggtggttttttgttttttttgtttttgtttttgttgttgttgttgtttttgagacagggtttctctgtatagccctggctgtcctggaactcactctgtagaccagggagacctcaaactcagaaatccgcctgcctctgcttcccaagtgcagggattaaaggcgtgggccaccactgcccgacagaacagtgttttaatgtgataaaatttttctttttttaaaacaaaaacctatgttttttttatttgtttgtttttttgcttttttgaataaaagagatggctattcacttaaaacttctaatggactttctgatatgaaaaagtagtcttagagataccattgtggaaccatggccataattaatttagttttataatctgtgatataaaataaatgctgatacctctagttaaatatagaagatatgaacaatatagaagaaattaaaagaaaccaaccatgtaatgtaccatttagtttgaacaaactttatattttgttatttccttgaattcttgtcttttctgaaactcattccttgttttcattagttgataccactcttctcattataggtttcagcactttacctagtatcagatgtgaatcatactgctatttttttggaaaggaaaagatgaaatgcatagtccctctttctttttttttcttttctttttctttttctttttctttttcttttttaagaaaaataatgcctagtgcatcctaaggggaagtagagtagcctcaatttattagtatttctcccttaagatttctatttactatgcccctttgtgtagatatatttgctaagcgtacaatatgctaaaaataaagataatatttgcctttgctaaatgtgtttttgtttggtaacttaaaatgttgttttttgagtacctgttgtatagtatgtataataatagataaatcttatttcagataaagactcattagagaatatgtttttgtcctcacttttgaagtgacctgactctgtatcatgtgttactgatagaaaatacattaagaaaatccaaatccttagtttcaaagaaatgaaatttctccgcttggaaattctgtcccattctccatcctctctgttactgtttctcactgattctataacattgtacaggattctagactggagatgggaataagaagttatgtacaagtttaggaacttaaaggaggaatatactttcctctacagattgggctatataattttaaagtaagagctcttaaagcatagtaggagaactgagctaattttagtcttttatctgtacttaacatcatgtataattactggctggtacattatgtttcatgtcactttaaaaatgaaagattgttttggtctgatttaactttgtatggatcatctttctactgattctgaaattttctcttactccattttttttttttttttgagttaaatgaaacacagggaagaggtgaacgtaaaaacagatatatgcacataacttaaccagttgaaattagatgtctattcctatactgaagagtctgggagaacagtaaatgtttgtgtacacattttgtattctgtatcctttgtcttctccctttttccatctttcctcttctcttttttctctctttctaacctcatgtctcccagttctttcctctctcactgttctctcccttttgtccttttcctttcccttctgcagatgcaggtatttgtaaatgttggattgaatgaactactttctagattgttcaggtctgggttaggatatctgctgtaggctcttgaaatatgtatgtatggtaatacataattctctaggcttgagaatttaaaggtaaacagaattaagcagtactatagtggcctggacaattaacaaagaccttctgaaggtcttttaaaaattgatactaattcgtctttttagtggtcaagagataatagcttaattatttagacacctattctgcgcttaaaattatcatgttataataatagttttttttggggggggttcttggcattaaacccagggaacatttcttctagtcctttagtcctttatattttgtcttaatcttttgaattattattactattattatcattatgtgttgtataatgtgtatttggacataagagtgccatgctgtgatgcgggtggaggtcagaggatagttaggtagattaaggtctctcaatttttaactttaatcccagagtgttttttttttttttttaaagtgtcaggcttatatggctttatcctactcatggagataatctcaagagccatacatttttatcttattagcatacttttaataaattgggaagattgtgtcatggaagtctccatagtcttagggttttgtttttagcttagaaattgtatattcagattgtttcttattaaaacatgttataaaatatttaaagcacttaatagtatatcaataatctacttacctaccatcctggaatataaatgccagttttgatttttgttttggaaacttaatctcttcctccaagtcctaataccctctcttcttatccatgtaagagatttcttgaagttcttgaatatcttctgttttgtacttaaatatgacctttgccaataagtgagatatcatgcttaagaatttatagatgtgtttcatacatacttgccatcagtttatgtgtctttattttatgtgttttattttatgtgttttatctgtttttgagatgtgtatgttgacacatatcttttatggtattatagtatatggataactaaatagtattgtatcccactgcttatgaatattttgaattgcttcctatattgcgcagatcatttttatacttcctttgtaaaaggttttctttagggaaaattaaagggatgaagttgttagaaaataggatatatccttaacttgattagatacggcaaattttatgtaaatttgatttgccaacatatactgtatcaccagtgaatgaacatttttgtttctagcatctctaaccagtacttggaatagttagattttaaataatgatatcaaatggcatcttttgtgtttgctttaattctgagtggttggtaaaatgataagagttttatgatttttttctacatgcttcaatttaatgattttaattaattttttttaagtgctggagtttgaaatccagggcctgctgtatgctaagcaattttctgtgtgttttataatttacagaaaaaaatttaaaagaaaagaaactctacaaggtttttttttttgtttcttttttttttttggttttttgtttgtttgtttgtttgtttgttttttaaatagctgattatctgtccagtcatcagtatatgggcttctgtatgctttcattttgggttgttatggtattttgtgtgtgtgtgtgtatacacacacacataaataattatatattatataatagatatataatatataatacatacatatatatggatttaacttttgttgtaaatatatagcattctcttgattatatatctaggtgtgagttgtctgggaaatatggcaactatttaaaactagaggcattttaaaacttttctcaaagtggctatatatttatattcctttgaaatacttttattagtaatatgtgaaggttctgatttttttcattgttagtgttattgtcattctcagtccttaactgtcattgttcatttggggtgctctaaagttttaagaagaatagttttgtttgttttttaaataggcttttatagataaagagaggatggaaattgcagagcacaggaaaacatttcttgtggaatatcctgagaagcaaaattattaggaccagaaatagagatttctgatatatgatagagtacaataaccaagggagattgatatttcaggatgtcatcatatatgggtaatgtttggattactggatgtgaccatatgacaaggacatcagttaatatgtaaaaaaaagtttgaaatttatgttaacagaattgagaaggcatagggatttttttttaatatgagagggatatgaccaaattctaatttctaggaggatagttctgtcaaatatgtaagagagaaatgaggtaaaatgacaagactctgtatcacaacaatcttagtaaccatgtggggaaaagaagcaatggattctttctttaaagatgaaatattacaaaaaagaattttaaagctaatttttccggcgtgactttgagttagactggtttataaggaaatggacatggatagtcttttgaaacagattgaagtttcttagccttgcatttacatagctacccaagtttctttttttttttttttctgtgctgttttattctataaaccttttaaaacatttagtataaaaattaaggacatactctcaatgttttgtctagtctggaaggaagggtatactagcagggtttggaaacatagttttacatattgtgatggagcaattaagctataccgaaagcaagtaaaggccactggagaattattagggatagtgttggattgtggggagatccctgaggtggaattggtagcagtgagtgagcaatatattatatttggcaggatgatttgaacttttctgatttgagtcattggaacgagaatcctactgttatgccacaggatttactagtatgtgataaagtttatctttggggagaccatagtgttatatcagtccatctatcaatttattaatctgtctgtccatccacccacccatccatcatttatcagcccatccatttgcctttccttctttccttctcactcacctacctgccaacctatttacctataaataatatgcagatttatttattttgtagttgcttaatccataggattaggttttctccttatgacaaaataagattaaaagatattaaaggctgaaaaatattcaagacaagttataaatgaactatgaacacaaatttaaaatcataggagagcttgttttaagctctgtaataagtacattgttattgtttatttgtaaagaattgtgatagacatggagtgacttagttgagtaacagagccctgttatgtgtcaggaaagcatctatattctttttatacattttctctaattcaacaacttagcactcttgagagactgacaggtcagaggatttagccatggttgctactctaggttttatatagcagaagtttttcatatagagattacctggaagtggacttactgtagatatctgaaggggtttgaggaaagggattgtggagcattactttttgtacatgaagatgggaaacatggctttcctagtcggaaaatattcagctcacagcctacagagctaccctgctacttttcttggcaataggagtggggtaatttgtctttcaatatatttttggatctttataagtattattgaagagaaattggcttttattttataatgaatttgagtaattttttttctgaaagactatccagtttatgttaaaagaattgagtgaggtgttttatattttaggttaaaaaatctctctaagagcctgattttagagttcaccagctcctcagaagtttggcgaaatatggtatgtttctgttttattttttgaaattcatattgcatgaattattttaatattacggctagtataatgacaaatgcgttcaataaatttgggcgcctgtcaattttaaagactcttactaggtgctgagtatacaaccaggtagactgtgagggatataagtggggtgttggaagaatttgtgagtttactgtattatgagacaaagtaatatgaacaagaaggtcaaggaaatagacttggctgttaggctgtgggtatgaaaaatctctttcatttatttgcaaacatattttatataaggcactcttatgataacccagactagggttttaattctgctttaagataattgaggtttagagaggttatgtaacttgtccaagatttccctatagtaagtgatcatggagagtggaatcttagaatgtctttggaaactgttcaactgaacattgaacctaataaagaggagactagtggagagtacttgatttagtaatcctaagagtatatatagttctttaatgaattagttgattttatttaagctgtgttatctttgtgtttgtaagttagaagttagattcatttcagtattcacataattccacataagctgtttgatgagaaactaagggaactatgccatggaccacatttatttcaaggatgttatttctctcccttgctagttcagtgatgcctctgttcttagtagaagataaatagttatgatagggaaatttgggaaattgggttatttcttaacaggggttataaatcctatttattgggaccccctgattttgtttatatatatatatatatatatatatatatatatatatatatatatatatataatataaacttgagccaactctaacaataatatgggttcaaatattgatgctttaataattcctttgggattctcactacttcctgttttaagttgggttctgattccgtgctttcagccatctggcttgtctgtgctgtcaatttgagggtgttaattgtgaaggggcttcctcttcctaatcttacactcccttttcttctttctttctttctttctttctttctttctttctttctttcttgttttgttttgttttgttttaagctcattcaaatttgttctatgtttatagatcagtgaaagaggattttgggggaaaactggataaaaccataacagtattggcattttgtcaggagtatagtatgataaggagggctgtgaaacgaatcagatttgtttaaaatcacatatgatagttcagatatgtgaataataggatattcattcatattttgctttatattacttcctagaattgagtcttagtgggattgaaaacgaatgctttcttatagatccaaaggtctaaaagttaatgatagattatactacttaaataatttctgtctctctgtctctgtctctctctctctctctctctttcatgtgtgggtgcgtgtgtgtgtgtgtgtgtgtgtgtgtgtgtgtgtgtgtaaaactttaatcaagattttgcctgtttggtagctgatttctcccatcagttaaagactcttgatactaaatcagtttcattctaattactgccacaatacatagtctaaatttttgctttttgtatgtatttaaattacaaaacactgtaaagcaaaactaaaccatagcaaaattctaatacttagtggaaatttagctgatattggttttttggtcttaatttcaacattatttacaaaatcttcggcaagtcagttaatcactctgaggctgcttattgttattcttctattttgatcttgtagagctaaagtcagtggaatgtaagggtacagttgattgttgtattttgtgagccatatagtactacattgaaaagtagggattattatctttatcagaaatgcctgggaccagactatgtttcaaatttaagaatttttcagattttggcatgttcctatagactttactgtttgaacatacctagtctgaaaattcaaaatcggaaatattcctaaatccagcccttttttatttgctgccatgatgatttaaaacattctggattttggagtagttttggattgagaatatacctcattttctcaaatgaagagaccatttaagaaaacaatatactgaagaatagttcataaaggttttcctgtgataattattcttctaattttatattgactactgatttaaagctttgaagataatgacttgaacaatgaattgggtttatgctagtgttctaactaaaggtttgtttaatttattagaattattaagcctacgttcagatcaagttagcagctagactggtgtgacaacctgtttttaatcagtgactcaaagctgttatcaccctgatgtcaccgaatggccacagcttgtaaaaggtaattttgaatgttattttacagtcttagaaaggctgtcattgtaagatgaattatgtgctataaaaatgacaaaaatgcataggtagcaggaatattgctaagaataaaagacctaagaacggagccatttcttcatttaacctcctttctcagatatttattatagtgcatttcttacttacccttcagttcatgaagataagtaatcatcaaagacctgtttttctgcatagattaataagaaaatatgtcttaagtattttgaagattacagtgtggacattttaagagatatgtggaaaatatcttaagtattatttttaatattttatgtggcaggagtttcagtgcttctccagaaatgttgcacctttagtaaaatgagtgtactttttctcctagagagttacagtggagttaaaagtgcacctttacctccttaaaaggatggatttactaggtcatgttccagtgttcagattatttgttttgtgattacattttctgtctttaaagttaatacctaaaattgatacttttaaaagactttttcctcaccattgttactaggtatttttcaggtttcaaatttcattcattcctttattaatattctggtaaactttaggataacttgggtcagtcttgggttggtagtggattttttattaacttttagttggttctatattttgaatttggtaaaattaggagcatgtcctgaattcttatttcaaatgtattgtcagtaaaaagcagcaagcattttaagagcagagaacagttttataactattagtaggtgttacatatactttgtggtttgtaacacctactaatagttataaaaatagagttactttgaaagttaactctagttttaggatatattttggcaacttaattagaatattattaaaattgtctgcatagacattcagatgtacacaatgatcagaaacatgcttttgttgtatttatatatttttctcttgactaaagtaaaactgtttgaatgggagcagcctctgctatactatgtctaagagatcaagaagagtataatttaagaagaataatttgtttggattaattttactctgatctttctggggtttcttaaattttagtttggctaaatggtgcttaataacttactctaatatttgtgaatattaaatagaagtctagtatatttacaatacttggttggcattatgttactggcattcacatactctgtagcaatcagaaattgcgaaaatagctgtagttggccatttgacaatatgtttgttctatagttcattttagggtcttgaaactgcagcagttctataatattctcttgagatatagttctttttttctcttatcttatattttcttatataatattttttctctcatcattcttaaccttctctaaatttttcttttcctgtacatttagaacactttgcttcctacctgtttagagacttctaatttggcttcctaattgctaacaggtttttgttgttgttttgcaagtcagctttatctcacagtcttaataatatatgagatgttggaaagacacattccaaaatgagttagctagtgcatgggttaccatcatgttttaactcttctagccattttatatgagatataagtttggaaacaatcttggtagtttcttaaggctgtagagatcattatttctgagatatttgcttgttttctgggggaagagggtggagaattttttatttgatatcactcctaatctacatttttcaattcttatgtaattttgtgataaacagaaaaatataaataaactactaagaaaatctaaactgtctgagcttttggggtctgtttttaatcgtatcttttttcctttttctttgtgtgtgtgttactgacttggaatctaaatgaattacaatgagtattattttgaaagtcaagcaaagaagtgaaatttctttgacactaaagaagtgaatacattaatttttaagattttttgttgttgttttttgtttttttaagacagggatttctctctgtgtagtcctggaactcactctgtagaccagactggcttcaaactcagaaatccaatgcctctgccctccaacttctaggattaaaggcgtgcgccaccattgcctggctaagatttttaaattttctgtgtgtgagttttacttgcaggtatgtatgtgtgtaccagatgcacatgtgcacctgatactcacataggccagaagagggcatcagtgctggaactggagtttgtgatggttgtgagcagctgtgtgggtgctaagaggcaaaccttgatttctctgggagcagtaagtgctcttaactagtgagcctcttctttatcccctaacttaagaatcattgctttaaaaaatcttccataaccataagccacaaccagccttttataaactttttgtttaagttgaatatctgaagtcagtgataaatttacaaatcaagtctttaacttgaaagactaaagtcagtagtaaattcacagattgtctttgtatacaaatttgaaaatttaaattattcttttctttcttaacctattttgggaatttaaagcattagaaataggtattaaaataaatttaccttagaacattgattgtctcacagtaaagatatgtagggtaacagatttttttctttttgggaggcagtgtctcactatgtagaacagcctgtcctcatgctaaatcctggtttagcattctgatgacaggaagtatagcaaagtattgctgtgtgcatcactggaatttgttctttaaccagatgttcagaatagggaaattggcttatgttccacccaataaaaatgggatactctttggtgctttatatgtatttctatattagctaatatattaaaaaataaagaaaataaccagcagatattaaaactaaaactagcctacaattatctagcaaacataatgctccatatacacggtgacggcagatagtgctttttagggaaatctaatttccttatagaaccacaggaattatgattagaatggtgcatagcatttaaatatcttaaagatctatgaacactgttatatttgagtttaaattgtctactgcagaaattggcagacatttttcaagggattttttttttttataatgttttaggttttgaaggaaatagttttttctgcaagtacttatccttgctttttctgaatacatagacagtgtataaatgaatacaaatctctcagtataatatcacttcaaaataaaggtgattatcctacaccttagtgtttgctcaggttacagtttgcaaacacttcatttaatttcaagactatgaataccacaacccaacttaatagaaagtaacagtcttgttttttaatatgtgtttgacattgtaaataattatggcttatactaatttgatatctaaatataaagattttaattttctttttaaacattgaggtttctaaaatttgttcttaaatgtgttgtgataatctgatctttctactttttttttcttagttttaaatcttttaaagcaccctttcattggaatttaagtcttgttttccagtttatcttccttacttatatttctataccttttttttggaaatcactaatatttgtctttaattacattttacagatcaccaggagaatcccagtctgaggacattgaagctagccgaatgtaagtataacttcgttcaggttattttgtgtctcaagttgccctacactattttatttgaaaatacctttcaggcttaaaataaaaaaaggtaaaattgaattaaaaaaagaaaaagaaggaacaactttaaattgtatctagagattggaacatgtctacttatatctcctaaccaaatacttccaaacctctgcaaaaaattagatgtctaatggtaagtagataattacatacatgattctgaattttcaatgttttttgtgcccttggcagttgttgataaataggggaattagaggaagattcaaacatctatgtgcctgctattaatttataattcctgaaagcaagattgtttaaatatgacccctgttctaaatattaatcatcaggtgctatgttttgggtataaagatgcttgagacttatatctcaatgcttcagaaagagcagaatcagattttttaattattgagatagaattatacttggtatacagtgggaatacagaggagtaccaaattatgcaaaagaaatctagtgcatagtaggaacattggtatagctgagtaaaactaggttgaatcctgaaatgttactggggattaagcagttggatatttgaacagtgttctaggccaagtcattgccaaggttctgaagcaagacacttgagtgtagggaaaagtaggaaattgagaaccttttcaaaatttgacaatgaggaatgaaaaatgaaaataggaataactagaaggaattaagcaggggactgtggcaaagacttggtgaatatagcacttgctatgtaagtattaagaagactggagtaagaggcaagctggctgctaggttagcataattgacaagctttgagtatagtgaaaacaagcctctgacttctaaacacacctctctacatgtataaatctacctataccatctatgttaatgcacacacatatgcattcctgtcttaagaaatgaggaggaagtaaagatagatgtgtatagctatgtttaaggtgtggttgaaaaagtccaggttttccttactagaagcagattacatccctttaaatgcttaagtacattgtgaagtcttaagaaacaactatgaattatcctttaaatttttgagaccatgtaacttctctgataactttaaaacacttataaaatgtataaaatttactctttattgttctaaagtatatgagccagtggtattgtaaatattaatatgtttgagcatttgtcatcagaactgtttgcattttgccctactgaaactttgtatgcattaaatagtgacctgtttcttccactgtggctggcaattaaattctactttttgtctgtgggtttggtgcttctaactatctcaagtaagtgtagtcacacagtttttgttttgttttgatgactggcttattttatataacacagtgttcttgaagtttatgtgtagcatatactagaacttcctccttttttttttttttttttggctgaataacacttgcttgcttgtatatgctatattctgctcatttgttaatgggttaattctgtgctttagcaattgtgaataatgttgtgattagcatgggtctaatcttttgtcaaattcttttggtcctatagaatatcatggtaattgtatttttaatattttgagaatatatcatgctgttttaaacaatagctataccattttacttacatttcttagaataaaagttttatacattttttttttacaacttgacccgtatattaaaatttctttggggaacaatagtcatcctaatggatgtgaggttatattttattgtagtttagtagccaaataacttttgttgttgttgttgttgtttaaaagaaaactcgtttattttgtatacctagatagctgcaggtatagtagaaactaaagaactgccttccccatgtaccttttttccccctccccatcgagatagggtttctctgtttaaccctggctgtcctgaaactggctctgtagaccaatttggcctcaaactcagagactggcctgcccctgcctcctaagcgctgagattaaagtgtgtgccaccacatctttgctccccatgtactttttttttctttttcttttcctttttctttttctttttctttttcttttgaaaaaggtttaatgatgttttgtggaacactatagttataattgagttgagattgagtgtactgaaaacttaccaagatatgaagggttttaaaaaaacagaccaaatgttgaaagtttcatgcactgaatggcctgcttagtttagaaacctcatagtgcttgcagttagactgtaccagtagtctctaatagataatattttagattgaatattagcagaatagataggacaaaccattagtagtgtttcatgtataacacttttagcattagagcattttaagtttgcatgctattattgatggccagagttgagaatgttgtgtcatcagaagatggaaaaatcaggaattaagtcttttgtcacataaagcccagaacctaatgatatcactgatgaaattcactaaaccttgaagaactaatactataagttaagtcattactctcatatgaaaacaaaagtctagtactataggctagtaacaaaagttcttcagaaaggaataaccaactgaattaaacaatacataattattattcattataattaagtggaatttattttagcccagtatggtggtgttgcatgcctttaatctttaatcccttgggaggcagagacagtcaggaggaagttctaggacacccaaagctacatcaagaaacactgtcttgaaatccccaaaagaaacaacatcagctaaaatcaaaacccaagtctgcctaactacaggggccatattgccttactctctgactcaagcattcttgaggctgcaaggtggctcagctattaggagcactgaccactcttgcagaataaaaaaaccagtatgttaaataggacaaagttgtgtccttagttaatatcctcttttaagtatcacctaatatattaaaacaggaaaagctttttaattagtgtttgtaaattttgttttaaaaacataactacaaaaaatagactaatggggttatacaaaacaatagctttctacacaagaaaagatatagttaacagataacccccctatggaatgaatgaaagcattcacatgctgaatagttactttatgaaatgtgtaattcagacagctcatggaagaagtggataggggacctaaataggtgcttctgaacaagtagttccggtaggaagatagctcagtaggtaaaatgcttgcctaagaagcataaggacctgatttgataactttcataacaacataaaaatgcagtgtgtggtagtgtacacataaaattccggtgctggggaggaagatccaggaggatccatggggctaatctgattggtaagctctatgctggtgaaagaatgtggaactggactacagtccagaggatgacaagtaaggtggtatagaccagacaggggaaaaaaggagtacaaatggcaaagtggttaaatgagtttttaaaaattattttgatattataatattttttcttttcctctattctttgcagaatctcaaatatttcaattcttgctctttttctgtgttgaggaaaaacctatttatttatttttgttttttgagacaagtttttctctgtgtagcctgagtgtcctggaacttgctctgtagacaaggctgacttcaaactcagatattctcctgtttctgctttctgagtgtgagattaaaggtgttgtaccaccatgaccagcatcaaattcatgagaaaaaaaattctttacctttctaatcatctaagaaatgaaacaacagtgagatactacttcctacctgctagaatatatgaatgttcatgttggtgaggttgtaagcaaacagaaatcttgtacacagttgtttggaatgtaaattagatcgattatggaaaataacaggttcctaaaaattgcaatgacctagcaattgtattatagaaatatatagtgtgttataagagatacctgcagtttaattttgattgcagcattaattaaacaaaatgcagaaataaaccagtgtttgtcagtggctaaacaaataaaaattgacatatatgatgatgtaatttttcgccattaaaatttttttctgaaatcttatgtcggtgacaacatggatggaaatgatcctttatattttcaatgaaataaatcagcacaaaaacaggtagtgcatcatcttcctgtacatagactgtaaaaacattctaaaaattgtttgttacttagagtagaataaatgatagacataaaaaatgcaaaatgaatagaatgtagttcaggaccaaaattgtagagcatggtgacttctttctgtatattttcttgaatatcactaaaagtcaactattaagtatatgtgcaaaagtgctatgttagaatttataaactcatttgatgtatcacttttgcatatgataatatatgtagttcttatttgtcaatgaaaataaaaactttggaaaaacagccgtgtcttcatatattaaaattattattgcatgagtgagtgtttttaacagacgaataacattttaataatcctacatatggtgtttattatgcttaagataaaggagttatggttggaaataaagagattgtaaagttctcttattaagaaatacaaataattttggagactcttaatactgggatataacatgcacattgacattgatgtcctttagcccatgagtttaatagaagaagaaagaaaaccagaagatatctaggtggattatatgaaaatttcatattatgaatttgtgcatatagaagtattaagaattttgatatttggctgggtatgtttgcttgctccacttctgtactcccggtacttgggagcttattcagggacagcttcgcctatacagtaaggcaagtcaaagttacatgagatcatggctttaaacaaacaaacaaacaaacaaacaaacacaaaaagcagctaaaagcagggcctaaagagttggctcagtgtcctgctttccaactatgtggactagaatttcagaacctatgtaaaaagtgaggcaaggcctttcatcccagccttggtggaggggcagaaatggaatggtggttgaaatgtgttcattcagtctagataattcagcaagtgtcaggtttagggagagaccacgtcttaaaaaattgtgtgaggagcattagaaaattatgaccgcctttgctttctggtctccaaatgcacatgcatgggcatgcatgcctccatgtttgtgtgcacaacacatgtatacaccaccccccaaaaaagccagaaatcaattcatccaaaatagaactgttatttgtatgctatcaatcccttgaaatctgatagacatttgcatcttatttagtaggactttattttaaaccaaattctagaaagcatccttagtttctctttgtgtcacatattggaactgtttgcaagttatgttgcatttatcttcagaatacatttcagcttctttaaaaagcatttgtagtaccattgccatcttttgataagggacatcattgtttctcagtacttttgttcctacctctatttactaccaacaattcaatgggcttttctgattaaaaaaaagttaagccatcttttctatactcaacttttcaaaggtttcctatttcttaaactatggttagaaattgatacagccctgaactggctctttcatttatgtgacatcctgtactagcattatgttcttaacctgcaacttttgaggttttagttctggaacttactgactgttccctcttgagttaatctacgtgtttttcttttttacttgtttcagaattcttagataatgcctgtcataggtatcttttctgagtatctctatcaaaatatgattgtgtcccatcttctcaattcttactattttcctttctgagatttagtatcacttcatttcttttaaggtctcagtagaatgggaacctaatgttctgtttatatttaacagtctaacaaaaagaaacttaggggagtaaagggtttatttcagcttacatgttataggccatcgttcaaagtagtcagggcaggaactttatactgttgctgactcaattttcagacctaagcattgctaacaccacttacttacagtccaaaaccacctgcctagggaatgctattatccacagtacactggtccctcttacatcaatcaagaccttcccctttcccccagtcacacccatgggccagtttaatctaggtagtccctcaattgagagtcccttaggtcacactacacattagactatcaaattcacaactaaagctaccttgaatacgtagcaaaatatataaggaatagttagttaatgagttaatgcttgcttactaagtgttagtgaaaaatcattaaatgtatgaaaaatatttagtgtctcagaaatatattgtggtagcagtttatttctaaataactattacatattctcagcctgtgattatgagggataatacataacatcttaagaatatgccatttgacaaatcactttgccttgttgatccttgaatgttttttcagaattttttatgagagctgaacatttttatcagggtgacttctggttataagatcggatgcttttaagtttctgtgtgaaactgaactctaattataggtggttctattttcaaaaatttttctgggttttttgagcatactcttggtcagattgaacctttgaaggttctttaacctaagattagccttctaatatggagaagaaatctgagaagtttttcatcaaagtcaaataactagaggaataccaactaaaaaaagtaagcaataacaaaagagaaattagagattattgagtctgtaatttggtattttggaagatacaaggattagttattgggtcatgctttcactatatatagttagtgtggaatagtggagtcagtgattgctattggaccacagaaatgatatggaaactttgggaatgaactgtgatataactaaggaccattggttggttataagttgaatatctcctgattacttttctcgtcagatagtttgcatagcattgtcaagttgtacagatcctagttagtagagatcaagcttcaaggtgagtttttgcttaatttttccatttctttactgaagtgtgttatatcttcagtagtagtgtcttactgtcaagttctggagagtaaccaaaaactatggaaataaatagccagcattggaagagagtgatcactgggatgtcactggtcaacaattcaagaggttgaagtttaatttttttttttttttacaaaattcttttttcctttaaaaaaatttgaaaatttcatctagtctctaaatgaatataatcacttcctcaactcctcctcttacagccctctcaacccttccattattttaagattatactttttcaaactttttttcctttattctccattgagtctagttttgcattgtcaggctagtcttggaattgggacctgctgtagtgtgtagtcagattaccaggggttcataagacacttgtggtaggatgacatctctacccccacccccccatgctggggttttggctggctgtagcttgggtgtattatcgtaatgacttgtcataagttcatatatgcatctagtctcttgctcttggaaaagactgtttccttgaagttatttaccacctgtgagtgaccatctttccagctctttggggtgagataaatgtctgatttgggattgagcacttaacactttctttttcttgccatgcttaccagttttggaataggatcatctctgttacttgccatatgttacggagcaaagcttctctagtgaaagctaaaataatgggcttttctcgggatatagcaataatcattaggagtcattttaatattatgtgcatttagcagagtaatggtatgggttctaccctagggcctattaccttatctattcacaagttcttggctcctttaatagtatggcctccactttatagagtagacctttaatgcaatcatatagtggctagttactcctaaaacacctatgcaattattagtaatcctatcttgtcaggccacttttagccttcagggttcataactggatgagattgaggcctttattctcaagagagtttatatagcacttgccagcacagtggattatagccagttgtgataaagttttccagtgagtaccagcataatgtctccatgctctgtgattcaaggatgtggttggtgtctatagcaatctgatcttaccatcaagaagttttcacttcgatttcattacttgaagtgtctgtttttatgtcagcaccatgctgtttttattactaaagctttgtagtataacttaaaatcatagatgatgatactgatagcacttcttttactattcaggattgtttttctgtcatgtgtattatgaaataaattttagtgtttctttttatgaaaaatcaagctatgattttgatggggattatattgagtctgtaaattgttttaggtagaatgactatttttacaacattctgagcatgggtggttttttttcaccttctggttgctttttcaacatattttctttaattttttaaaatttaattatacaactcttgtacttccttagtttgatttattcaaataatttttgaggttattgtgactgggatggtttccctaatttctttgtctttttgtttattatttgtacaaagaaagactactgagttttgtgtcttcattttgtattgttactttgctgagtgtttatcaactgtaggagttttctggtagattcttacagtttgctacttacaggatttttttttaatagaaccattttattgtaaataaagataatttgacttctttcctgactggtgatttctttagttccttcacttacagtatttctctcatcagcacttcaagcattatattaacctgaaataacaagcacaggcccagaatgtgcttgttttgttcctaattttagtaaggatgctctgagggtttttttttttttttcatttgttatttaacatgtttgccaggaatttcttctgtttttcctttattatgttgagatatcctctgtgtcctaaggttctcaggattgtgttacttgattcacctacatgtttctgcagttctcattcagccatttgtttatattgtctttgagttcctttaacagggatttgctgtttgaagatattttcttgtgcatcatttatgatgcttttctcagagatgaataaactgtgggtgttagtttctagaggagataattgtctctgtgtagccctgactctccttgaactagctctgtagaccaggaaggctttgagctcacagagatcacctgttcagtaatgtgttatttagttcccatggtttctgtaatatcttttgctgttaatatctaattttattccattgtattctatacaaagaagtatggtattacagtattcatatattatgactttttcagtgtcttgataggtagttgatttttgtagaaaattccatagactgagaagaatgtattagtatatgggtggaatgttgtacaaatatctattacattcatttgacttaactccagagtttctgttttaatttttgtccagatgatctgtctgctggagagagttgggtagcgaagtcacccactatcagtcactgttgagactgacacgtggttttagatctaatagcattcctcctatgaaattgtgcgcctctgtgttgcttatgtgtctaaaattgtaacatccacctggtagatttttcctctaattttctttattttgtatctttggagaagggattaattaagaccatttacaatcagagttcttgaaagatgtgtgttttttctgtttatcatggaaaatttctatttgtctttgaatttttgtgtaaagttttacaagtgtaatgctttgtgttaccagttgtgatctttcaggatccaggctagctgttttcagcctgagagtcataactgccacaggggttgcgtatcagatatcccgcatatcagatatttacattatgattgattatagtagcaatagttacgaagtaccaatgaaataatcttttggttgggagtcatcacaacatgaggaactgtattaaagggtcacagcactaggaaggttaaggatcactgatccagacacttcatgctttaaagacttttgttgaatagatattaattttgatgagcctgctttatgagtgatgtcacttttttcttgtatcctttagtatcctttagtctgtgttttatttatttattttttaactataatatgttgggaagaatttatttactggccttttgtattgtgtttttctaggcttttgtccacacatctctacttgcaaatgttcattgcaatgagttattggtctattttgaggcctctaggttctgccgtattggatcctcaaccaggactcctggatatcctgttgttaccctgtgtcatggagatcctgcagttttggatgtgcagaactggcaacttcataagttccagcagatcataattggagtagatgttggggtaggccctgggtctgtgcttgggaggtagttgagttatttttctcagccgaggtcaactctcaagcactatcctgcttaacttacccaatgaagcaggatcagcccttgtgctctcaatgtccttgcatccagcttacctgcaacatcaccatagccagcttttctgagctgttatagtcaatttgcaggacctgtgctcctgagtgattcaatcagtaagggaaagggccagttctacctgctgtaggtagtgagaggggggtagaagaaggcatctctccctaccccatgccgtcccacctcagatgtggggctaaagcagatctccagtacatatgcccttgggttggattgttctatttttatcacagaagagttttacaatgttgaggaagagggctaatttagtgcaggattggaatatcagtttatttggcacgtgcctttttgttcttagacattctagatactaattctgttagatgtatagttttctgcattaaagattttcttccattattttggttgtctcttcactactgatttgccttttaactgttgcagtctcatttgtcagtttttgctatattcatttctctctctctctctctctctctctctctctctctctctctctctctctctctctctctctgtgtgtgtctgtctctgtcactctgtctctctgggtttcttgggatctttgtagggttatatagaaaagccctggttatgtctttctttttgctacaagtgtttatcagagtccttaagtaaagaatgcttttgtgtacttacagagataatttgttcttttctttcccatttgttttgttctggtttttcttgttttctctatgacttcagagtgctacattgaataatattatagaaactgaacacccttgtcacatgtctgatattagagaaaaatgacttcagtatttttttttatttaacataacaatagtctcaggttattttatagccttttagtatgtttgaggtgtgttcttttctaagtgctcttacctggtttggaactctcaaaataatatttttgtagaatggctttagtagttttcattccctgtttggtagaacactttgaggttttttgccgtttgttcttctataaagaactggtaattttagcaatgaatctattctttgcttttctttattggtaggatgtactgcttcagttttgttgctttctgtatctttagttttttttaatttccttttaatataatttttatagatcatacctgttgaggaatttataactttcttctagatacttcattctttttaaatgttgcttttcatattaattactaaagacctcatgtgttttcagtactacattttattttgtcctcatcttaaccttgaattttattaatttggtcttgcctttctttggttatttgggctaaggaattgttattctcttcaaagaaagaactctgtgttttagagttcagtacattaatttctatactggtctttattcttttttttttccaggtattagtttgtagtttgggttgttcttatttttctgagattgtgatgtgcattgttaagtttttatttgaattctgaccgaattttctaaaggaaggagtgaaacttcactgttagagatgcctttctgtatcataatatattttcctttcttgattttttttttaacatgacaaaataaaatacaataagatgaagcaaaaactatcatggtagtctgccttggtaaacaagaggaaaagagtcacaagagcaggcataagagtcagaagcctaattcgttctcacaccagggagtaccatacaatactaaacctatagctattttacatgtgtgtttgtgtgcacatgcgtgtgtgcctatgtgtgtgtgtattatatgtatatacatatttgtagtataaatatactacatatatatgtaatacacgtaatatatgtaatacatgtagtacatgtatgtatgtatatgcatacatatacatgcatacatacatacatatataatacacacagacacttacaaatacatacagacatacatacagacatacatacctggtacagacccactgcttcagtttatgacatttcctatgagactttcgtagttgatttagagggtcttgttctggtatcgtccatcccctctggctcttaaagtttttccaccttctcttccaagggcttccctgctctctgctgtaaagtatttgattgagagctcccatttaaatattctgtccatgtaatgtctgactgtggtctctccatctctgcacctgtttccatctgctgccagagaaaacctcttttgacagtaactagattaggcactgatacaatgtgtataccataatcattttattgactttaaaattttttaagatttaaaaaaaaaatttaaaacgtaagtagtgtttttgttttaccctaggtttctggttcttagttatccaagcagtctggatataggcttcttctcatggagtgggccttaagtcaaatcagacattggttggctactcccactagttctttgcccctactgccttagcatattttacaggaaggacagattgtaggtcaaaggttttgtggctgggttggtgtgcgtatatctcttttggtagcttgtagagtaccttcctacaccaaagaagtagagtgtaggggtgaagagtccatgcaggcagcagcttggcttctccgtgttcattgggtagtgtggatattgtccttagcagtagggctctactgttagttttcaggtagcaacctgttgttttgacaacagcttaggctgtttggggattattctttctttctttctttctttctttctttctttctttctttctttctttctttctttctttctttcttgtcgtcttcttcttcttcttcttcttcttcttcttcttcttcttcttcttcttcttcttcttcttcttcttcttctcctcctcctcctcctcctcctcctcctcctcctcctcctcctcctcctcctcctcctcttctcttttctccctcttcctcctcctcctcctccttcttctaagatttatttatttcatataagtgggtacactgttgctgtcttcagacacaccagaagagggcattggatcctattacagatggttgtgagccaccatatggttgctggggattgagcttaggacctctggaagagcagtcagtggtcttaactgctgagccatctttccagccctgtttgggaatttctatgggaccctcttcacttaactgaagtgcaactcactttggttgtctggagacaagagatggccacttaagattctatatcttccattactagaccattttattagggtcactttcatacattcaaggacatttccaatgcactaggtttctacaccaacatggaaattctttcctccccaattccagctgtttctaccacactttccctcaaccccatctctccctccacctgctcacctccccacacctgcttactctccctatctactcccagttggctgtataatctatttcactcttctagggagatccttgtatccctactggatcccccctctttacctaacctctctggctctatagattgtaccttggttattatttacttaactgctaatatcctttttttttataagtgaatacataccatatttatctgtctgagtctgagttacttcactgaggatgattttgctgtttcctagtgtgttttcttttcatttgacttattcctttaaaacacttctgttctgattccttcagttactcttatgatacttaagattgtattatattgtcttcaggtatttgtagcatacctagttttttttttgcattttaattttattctcttattatttgttaagtacaagaaagtaatttttactattgttgacttgcctaatgttcaaaaatgtggtttatctcttagagagttccatgggctgccaaggtttattctgcagaaggtgagatgttttttagatgtcttgaaataagtccatttgatgtttggtacagtttagataaaatcaatcttccttccttccttccttccttccttccttccttccttctttccatcagataagttattaatttggaaagttaagattattactgtattttactgtattttgacttgttactttctatatggatattgtactttctggtgagaggttggatttttttttaagatttatttatttattatatgtaagtacactgcagctgtcttcagacagaccagaagagggcgtcagatcttgttacagatggttgtgagccaccatgtggttgctgggatttgaactcgggaccttcggaagagcagtcgggtgctcttacccactgagccatctcaccagcccgagaggttggattttacagtagtctggtagtgcttgtttttatgaacttgggtacaccatcatttaatgcatatatacttataattaattgtacatccctcattggttgttttctttttttaaatattttttaaaatatttttttaggtattttcctcaattacatttttaatatatttttaaagagatttatttattattatatgtaagtacactgtagctgtcatcagacacaccagaagagagtgtcagatctcattacagatggttgtgagccaccctgtggttgctggaatttgaactcgggacctttggaagagcagtaggtgcttttaaccgctgagctatctctccagcccagttgttttcttttatagtatacagtcatatacttatgtcagtagtccagttcttttttgatttccactcacttttcagtctccttttttttttcctttagcttctgttcaagtgaaatacatttcttatagacaacaaataatttgatcctgcttttaattcatttggctaatctgtctcataaatggaacgctaaaaacatttatattttgttgtttctttcattgttctgtttttctttcattaacttatgtagacacagttgcttctttcttaatttttcatatatagaattacaaaattcattttccttgagctcctctgtttgtatcattctgctatgtgtaagtttcctttaagtgtatactgtagtttagtggtcacaagtggccttatgttatgcctaccttggaaagtttttatattacatttaaaagataactttggatatagtaatcattgaaaagatttttgtctttaaaaatttctagtgagaggttggatgttacagtgaatttacctttgttagtatgttgatacttttattttctttgtagtgttaggatttgagctacactgtgctcaggagcaattctttctgtccatgatttatttgggttttacacatctttctgtatagatgttcatttctttctcgatattttagaaaatttctgctgttatttcattgacttagtctcagtgcttttaagttccttctgctccatgtattctttagtttcattttgatcatgttctaaaaggtttggttgtgtttacttattgtgttgttgtgtgtctgaatacagatttttcttcaattcctgctgttctgtcttgtacttgatttggtctattatttatggtttccactgagatttttaattattttatttatttccatcatcctccctcccagcaccagtctcaatttctttgctaaacttctcattgacatgtacttcagaattctttgaacagcatttcaaacagttggccatctttttattggttattaaatgctgatcttctgaaataactttgttccatttataatgttttgtttgtttttgtgttctaatttgtacacttgtcagtatggatatgttttccagttttatttgtaattagccttctgttgagttttcaatccttaacactactcaaaggaggaaagaaacctccaacacatacaataaaaccaaacaattttcagatatagactttgaattgattgatgccagcatttatagcaccattgataattaaaaatatgtttagaataatgtaagtagtcaaaacttgtttagggtcaaattagaaatagcagcttaaggaaaaaaaaaaggggaaaggggcaggaaaagaaaagggaagcaagtttaaatgaaaagaagtagaatactaagaataatgggaatggaacaaatggtcaataagtaaagaaagcaaacaaaatagaaagcaaacaaataaatagaatagtaagtaaataatagtcttacaaaaaataaagtctaaaacaataacaagtaaaaggaagtgtattggagtaatttattctgcatcccctaatattccagtcctgttattgaggctggtgctgatttggaaccagtcaaagctcagatgtcatagaaaactatcttcggtttgagattgtcagtgtttttgaataccagtgtctttgctagctgaactttgctgtacaggacctagggatttttacatttattttttaaattttcacctatttatttatgtattcattcattcactcattcattatttccttcagggactttccagcttttctgtcttagttggctactttcaagccacagggtgtctcccaagtatgctttaaatgagggaagtcaaaaaagcactgtttgttctagagaactggtctctatacttttagatcctgcctgtcgtcaccacattgcaaggggtatcagacagctggaatcaatttctccactggaccttaccttcagagttgtcaagtactgtaggcagcaaccctcatgacagacagagccaattttgtaggcttgacactttatcctccacattgtagggtttgatccttgccacagaagggctggttaattgacacagtgcccttcaagccttgtctactttgcttgagtttctcagtcaatcaagtctctactccatatctacctgactcagctttcttcccacccatagactatggcaagacttcaccccttttccttatttgtaattgtttcatgtttttcaacccccaagattgtttgttttcaaacaaatgtagatcccttttcatgacacctgactagttctccagaatacagttataaactggatttttccctttccagtgctgacttagaataagtcagtgtcatgacgaaacctccaattaattctttgtgagtactcttgcttgttctgtgatcaagactattgcattgttttagtcagtcccatctgttttaccttatggatgagatatcccttatcaccaccacttggctggagccacttgctgcttttcctttttgctacatagtatttttctctgtttctcagttgtagtatctcttttgtgatttccaatattcttcatctctcttagaatttgaatttatcctttgatactctggaagttttcattcactttatcacattagcaccttgtagtcttgcatcttattccaaatgttcctgtatcttttatctttttcttatctgatagctatgcctagatattgtacttcatccattagaggtggtaagagtaaatatttctcctcctccatttcttcttcctcttcctcctcctttttatgtttatctgtggtttgctgggatatatctctgtgcaccacatgtagcatggtcggtgcccatggagaccagatgagtgtgtaactcctccaggtgtcacagctgactgcaccagtttgttggtgtggagaatcaaatctggattccttggaagaggaggaatcagtgctcttaactactgagatatctctatcactgggagtggttattcatgttctcaaatgagtctgtctgaaagccttttggcttcacaagatttcttttaagtaatgggattttagcaaggacatgtgttctttttcaaatgtgttttgtgcattggttttgactgtatttagatttaatatgtgtatatgtatatgtgtgtgtatatatatatatatatatatatatttatatatatatatatatgcatatatgcatatgcatgctatatgtgtgtgggtgcctgtggcatttaatgctcttaagctggaggaacaggcagttttgtgagccacctgacatcatgctaggaactgaactctgttcctctgaaaaagcagctagtgcttttgactagtgagccatcactctagtctcctatcaggtatctgctgtttgtatggcagtggtactaactctttccaaactaatacaggacagatttccattttcaaaattcttacttaggaaatatacaagttctaaaactagcattcactacaatcagccaatattcaccttctgtttacagaaagaagagtcaacctatggttttaggaaaagatctttgtttaaaaaataatattctttgaaagttttatatatttatacaatatatattggtggtgtgcctctactacactatgtttccagctccactagtcaatttctaaatttgtaaatgtttacttactttcttctaaccatgaaactgggcaggtgaaaaacaaacaaacaaacaaaaaaaaaaccccaaaaacagtggtttattcattttaaaagataaataattctatgtgaaaatttaattccacagttctatttttacaactagtactttgttgtaaagatgaataaaagcatttttagtatccatccatccacccatctatctgtctttaagaaattttccttattttatatataattgactttcaaatggttcctgatactaattgggtcatatttgtactttcagtcttgtaatacatgatttgatgacacttcaatagaccctaccttatactggttttaactgtattatgaatatctctggtgtttgtgagatcacattttttactcttgacaagtttctacattaaaaataacttggggcaagttgtgaaatttggtttactgattcctccacataaagttcataataaactcaagatcttcctgccttagtctagtatatgctactattataagcataagccaccatttcttggaggagtagtgatttttataaaggtacatcctttataaaaccccttacaaaataatgagacatttacctatgaaagacactaagcagtgcttactagattatgcatgggttaattgagtcttgggctgtatatgtttcttacctcttttgtccaatctttgtttttattctgcttatttttttaaaaaagatactttgaataagtcatattgttagttatctctttcatgtttctgtttcttgttttcatggcagctatttcactgtttttgattctcatgctgaactatgtgggaattctttattcttctagtgtataatctccttgatgctatctatatatagttatgaatatcttataactttatcatttttattatgatttacttactattcctaagtattcaactatcccgaaattaacttaggacccagcaaataatgttattagtgctactgagaacactgaaaattatttctctttattgtcatttgtggaaaacatcaattagttattaattaattctttcatatagtttatcctgtctgcattttcttctccctgcactcctctcagttctttcctcctcccttccctcatgcttcagatccactaccctcttctttcccgtcattaaagagcaggcttcccatgaatatcaaccaaacctggcataacaacaagtttcaataagattaggcacacacataaccttcccattgagggtggacaaggcaagccattgggaggataaagttctcaaaagcaggcaggagagtcggagacatcccttactttcactgctaattgtcacacaaggacatcaagctatacaaaactataacatatgcagaagacccaggtcagactccccaattgttgcttcagtctctgttaaccccttatgagccctgctgagttgattctgtgggctatgtttttgtggtgtcctttggctcccttcccctcttcagcaggactcttcaagggtttggctgtgggtccctgcatctgcttctatcagtttccgtagaatccgttttaatggcttcttagaaagtaataaagaagtggaaactattatttaaagaggaacacttttactggtaggattcacttgattcttataaactaaataaaaaaggcatatttttatttaaggactcactatattgtactttgatttccacgaagtcagtggaatatgaataggcaaaagtaactgctacctcctttttgtagagttttggttatgaatatcaggaaacggattcacttcatttcctgaactttactttggtttttcttttatgttccttcctacttccccactccctttttgttaaagtactaagtaggaagaaagaaccttactctattcatcttctgaggacaaagagagaaagtaaggaggccagatgattggttgaaagtttcactggcatgcacagggaattcattttaaggtgacaaagcattttacttttggctagatacattatgatagagaacatacaggaaatatacaagtacttgaaatttaccatgttacattagaaattatggacatagacatttaagttttatgcaattttcacacatgaaacaaaatataattttttaatgatttaagactataaaatattctaaacttcaactgtaaaaaaagtagatttgacacatgaggtatgatttagtgaccagtcctatgtatggattagcattggaaggttatcaaaagctattattagtatgtatgtttccaactttagaggccttttacatgtccttaatgaatttatatgccctgcatttggcattcaatggtatcatttataatgagaaaagaatagcttattattgttaattaatcatattcaatcatattaaccaatttaattaacttaatattaataaacgcacattaatcaaattagtcaacttaatatggttgattatgacctctgtttatttaatttaatataattattagtattagtgggctactacttgtaacttggtgcaaaaaagctggtcagtttcaaacattttctctgctgtctcccctttagtaatgctaaaatttcaaattttggaattaagcctagattttaatttttcagatttagtgcaatggagttctcttgaccaagtcatatactcatgcaaatgatagaaattatagcaattgcaatagcatctgatacttaccattagggcctagcatgtagcaggtaatacatactattccattaattgaggatttcatatatgatacaatgcattttgctcatcttcacctcctatttttttcctacctcttccaaaatttactgaaatagtctaaacacttgtaattcttaaatcatttgaattctgaaatatactggcatcctaaggatgaggaagctgagacacagaaagagactaaataagtagttaactcagatacagaaactgttcatgaacccaaacaatctggcctcaaaattgtgaatttctacctgttacagactgagtcttcttataaagtgcttagcatatccattttcaataaattaccgatatcttaagtatagtgatataatttattcaggagtttctatactgtacccagatagtacacatggttgttaagtttagattggaattttttggaagattttgttttctaattatatattacttaggtctttttttcccccttaaaactttttaggactgctggtattaagaattaattcttctgaaattataatctgtaaaacagtgattggaaataaattgaattctgaagctgaaaattgtcctgacttctttaatggacatagcataagatcaattataagatttgatcttttcaggtctttctcttttactagctgtagacagaagataatcttcaagttcaagtttcatatgataatcagagtacctgacaatgtactgagtttattatttggcatgtagagagtgctagctagacaaattataaggacataaggtggtaaaatgaggcctagaaaattagttcattcaactaattacattgagctgacttttggatggtctcatttctcccttcagtattgagagttctttatcacataaagaagtagtgtgtgtatgtgtgtgtgtgtgtgtatgggttgggggggcggcctagtactcttagaaaactagtgttttgaactttgaaattaacgcttaaaaatcctggatataaacataaacattggctctatttaaatcacgtagatgaagttttaaaacttccgtactgatacttagaaatttttagtgtttaggtacatacttacagaaaaaacgtagctaggaagaattaactcagtcaattatttagaaaaatagttaatatttcgaaacattcatcctacatttataacttgatcactagcttttgttaaggaagtaacaaaattaaagtagttggtaattattttatttggtgcatgctgtcagtatattgaagcggtttgctgttgttaagcatgctgagtttccataaataatagggaaataagtcttccttttgatgaatttttctcataagtggtatctctaacttcgtgatacattttaaacttcatcacatttatttattttctgtagatacatgtgactgggcatatgttttggtgtgtttagagttcagaggacaacttgtggtaattagttctctcctttcaccaagttggatacagggatcaaacttgagtcatcaggcttggcctttgtacactatgcatggtaaatatacagggaatatttctaaatataagtatctgaatgagttaggatcgtatgacataccattctttgtcatacaaagaatgacatagtcctaaagtcacttatcagtgccatatttgtttatctctagtgccattagtcacttagttctatctaaaataatgacatgaagttttagaatgaaattagatagattctttctacttgcagttcccatgcttgtatagaaccaaacggattccttagaatgacattattatgggccagatatacatttcaacttaaattttgtggtaatctccaagaatagaattttagagtcaaattatagaatttaggttatgtagaacaacttcttgtttggtaaaataattcattcctttaattgtattggttactttgcatgaaaaatatgttaatcaaatgttaattttaatgtttaaagttgatgaagtaagatgaatatgagtttcccctgatggaagtttaaacctttatctttcctatgacaaggatttaatgaagatagtgacaagtatgggctcaaggttgtatgccttggtgcttctctctcggtataatatgaaattagatagtttatttataaagcacttttaaatatctcatgattacttactgagtaaaaaattttaatctctagaagtttgatattaactggaaatcaagtatttgaaactgttaaaatgaattagtgattttatattagtgaaaagggaaactgccatggagatgtagcagtgaagtttgtttttgttgttttctgctaaatagttaagggtcctataccatcaacttaagcttatctttttttaaaccaaagaaaagcctgccatattaaaattatcttataagctgacatagtttatcacagtttttttagaaaatgtttattattttactaacactttgggaggtagtagtgaatttccagtttctacatctaaatatttagtttattgctttattgcttagctaacttttgccttatctgttgggctttgtttctgagctatactaataaatgtgcttattgtttgaatgtctggtacaggaagcgagcagctgcaaagcatctaatagaacgctactaccatcagttaactgagggctgtggaaatgaggcctgcacgaatgagttttgtgcttcctgtccaacttttcttcgtatggataacaatgcagcagctattaaagcccttgagctttataaaattaatgcaaaactctgtgatcctcatccctccaagaaaggagcaagctcagcttaccttgagaactcaaaaggtgcatctaacaactcagagataaaaatgaacaagaaggaaggaaaagattttaaaggtaagagattatatttcaattcaaaatggttaattgaaagctatatcagatttaaatgtggagggggttgtttatttgttttgattttgtttttttgtttgttgttgttattttgtttttatttttgtttttgctttttttatcaccttaagttatcgcactataatatagtaaaagtcaccttttctggtaaactgtggtaaaggactggtatttagtttgtttacattttattcttatattttactgattcattagttgtcagtcagaagcaagttatactctaaaaattaatatgatgatgagttgaactcagtttgtaatgatttatattgtagctaataccttattaggtcacaaaaatctactatgtacattgcatttgccgtgaatacctagtatcggctctagaactccagggactgtggtaaaaggagaaatacaaatataaagtgtaaagtagtctttttttttttttcttttctttttttaagaaagcagggtaaaattttgcaatagttatctgaaaattacattttttccttcttacattctgccctctctacgtcaggaattagatattttcatactgcttagggacgtaacttaccagtaatagtctttactcagctcttgtggggtttcgtttcattttgttttgtgcaagttaagtggcactattcttgtacttttaatactcacacttctatttccccagtaatgaaattaaagttttatactctgatacctggtactgaggatagcctcatgagtgaaaaataagcactcacgattaagctatgtccccaatgcatctagtattttaaaaatagttctatattttgaaaattcttcaaatttcctactttgcctcatgattgattttgttcaatctatttttttctcttaatggaagtaattgaatgtttcagattgccagggattagttccactatcacttgaaacatgtttaaatgaattagtgaaataaaattatagtacaacttcatgatattactttcacaataggactaaagaaaaatcagaaaaaaaaactttcagctttgctactcaaaaatatatagccagtcctatttcatgaatttgtttacattgtagataagtaggtgaatgctaatcaatattttgaatgtgaaaattgcattggctcaattatacatgtttctacaacagagtggacatgacagagtaacagtaaatgaaaaatagtatcccatcatagttgaatgcaactaactgtgggaaaaatctagtatataatggatatagttgccttgttttagcccatgggtgttccttttttacaggttctttgtttttgtggatcactccaaattttattgcctttacttctttaatatttttgaattatatatgcttaatcatgtttccctcagtttgataattatatttgttcactttagttagaggtgtagttatcagctagtgtatcacaactctgtttttgcgtgaaactgtttggagtataaaatgttatgttttaaagattttgagctgatttccagttctgtttctactatgtgaaaccatgtctcaaacagttttcaagcacacatatattagaatgtacaggtgaatcttaaaaaaaaaaagtttctttacttaactgtttgttgatacccagattagaactttttatttctgattgcagtgatttatatgcacacatgagaggggtgggggagatggagataaacattttaaacattttaagtagagtactacgtggaacaaatatcaatgaatagtagtttgtattactagaatgtcagagtgatttaatgactgtgctctgaaaggaagacattgcaaatcaaaggtgtgtggatctagagctttattctctttcaggcaggatgtatattgttctgtatgtagaatttgcactttctaactaattttataattcaatgatagggagataaaacattatattctaacagtctgcctatttattcattactgatattttctgtgttttggttacagtttagagaaatttggtagacttgaatggttaaagaagattccatgtatttttttcagttagaataacgagaaatgagctccatgttagtgttttcttttttacttattcttagtagactaagaattgaacttggcttgccatgctgcctcagatagggacatgtaactactgaaactcacactgtagaaggagaaaattaattcttttaggttatcaactcagctcaataccctcatcacctctaataagtaaatagaacatttttttaaaagaaagaattgaagatcataaaattaaaaagtatcaatactctagaatgggccatagacaggtttgtagtatatatagtttagtgctttgtggtttatgttttggaagccattccatcaatgaggacttgaattttatattgtttcttatttttgaattaggtacctttaataatatgtagcaatcataataaagattttacatgttagatatattggcaatgtatgaggtgtattatcaatgtaaccataaaattatcctaacttaaatgtttaataattataatatgttactctttggtgaaagagattagtggtttcaacattattatttgataaatatattactttctaaaactttaatatgtaaaatgttacctttttccaaaaagataagtatcttttgttttgttaacctgaaatggtaaagcctttgttgaaatttacatttggcctagtggtgagaagctagagacttttatgatcccaattctatttctgggagaaaataaatataggttttagtgcttgtggtttttgctttcttagcttctttcttctgtttgtttttaaatgactgatgactgtaataatttccagttgctctgttaagaattgttagaacctgagtaatggtcataggtagtagtagttgtagtagcagttttaacttcagtagagtttacatgagtagtaatatcttttcctcagcctctgaatggaaattctggaagaaattaggaatacataagatgagtcagtttggttttagtatatacaaaagtatagaaagagttgattgcaaatgaaggggctaaggaaaccttgttataaaaccttacctccttagttttttgagaacaatgcaaaggaaaatgatttcaggattttatatagtagctttttgttaaggttgtaataaagtacaatgaggaaatgacaagtatatatatttgttcatacctacaattaatgttacataccagtacatgtcttggttacaaggcatgtcttaattatcaatgcataattaataattatattttgttcaatgaatgccaagaaagggtgagattgttgggattacttgttaataagtaaattacatcatttaaaaattctaaatcaagtccagaatgtttagatattttactttttcactagcaattattttaacaaaataaacatgtatattacaacataaatgttctttttctttccattttctagatgtgatttacctaactgaagagaaagtatatgaaatttatgaattttgtagagagagtgaggattattcccctttaattcgtgtaattggaagaatattttctagtgctgaggcactggttctgagctttcggaaagtcaaacagcacacaaaggaggaattgaaatctcttcaagaaaaggatgaagacaaggatgaagatgaaaaggaaaaagctgcatgttctgctgctgctatggaagaagactcagaagcatcttcttcaaggatgggtgatagttcacagggagacaacaatgtacaaaaattaggtcctgatgatgtgactgtggatattgatgctattagaagggtctacagcagtttgctcgctaatgaaaaattagaaactgccttcctgaatgcacttgtatatctgtcacctaacgtggaatgtgatttgacatatcataatgtgtatactcgagatcctaattatctcaatttgttcattattgtaatggagaatagtaatctccacagtcctgaatatctggaaatggcgttgccattattttgcaaagctatgtgtaagctaccccttgaagctcaaggaaaactgattaggctgtggtctaaatacagtgctgaccagattcggagaatgatggaaacatttcagcaacttattacctacaaagtcataagcaatgaatttaatagccgaaatctagtgaatgatgatgatgccattgttgctgcttcaaagtgtttgaaaatggtttactatgcaaatgtagtgggaggggatgtggacacaaatcataatgaggaagatgatgaagaacccatacctgagtccagcgaattaacacttcaggagcttctgggagatgaaagaagaaataagaaaggtcctcgagtggatccactagaaaccgaacttggcgttaaaactctagactgtcgaaaaccacttatctcctttgaagaattcattaatgaaccactgaatgatgttctagaaatggacaaagattatacctttttcaaagttgaaacagagaacaaattctcttttatgacatgtccctttatattgaatgctgtcacaaagaatctgggattatattatgacaatagaattcgcatgtacagtgaaagaagaatcactgttctttacagcctagttcaaggacagcagttgaatccgtatttgagactcaaagtcagacgtgaccatattatagatgatgcactggtccgggtaagtttgactattatttaaaattggaattaaactaaaacctagacagtgatgtatttcaatttattcattttatctataattttggaaaaaaataggattatgttaacatttctgatctgtattgctacacctttgttgcttcttaccaaaaatactggtatcctggttgtctaatgataattctcttttgaagaagaatagatttttctagtactaggggaatgactcagtggttaaaacgtttgttgtgcaaacatgaggacttatccttggattttctgaatacatgtaaaacaggatatggtagttccatttgtaatagtactgcctaaagcaagatagaaagtatagacagaaaaatcctcagaagctaatctgatatataaactgacaaataactagaccctgtctcagttggtagaaagcaaagtctgatacttgatgttctttgacctccacacatacgttttccccttttggcatttacatgcacacatgcatgcatgcatgcatgcatacatatgcacacagatgcgcagacagacaggcacaaagcaagtaaaaggaatggattttctgaatcttgaaagccagcctcatatatttccattaagaagaaaagattggttttcaaagattggaacacatgacaaatggtattgttatacacatttttaagaatggaagatggaattggaagaaataatgcaataaatgtacattgtaaaagaataagagctgctcttcaaattccattatgtgtaacacaactcagctttctattgtgaacttgatgatatgaccaggaaaggttagtctgtattatcaataagactttggagttctaagccactctgtcttgtgtgacattgtaggattttgtttttttaaataataataacatgaatcttgaaaattctgtaaagtggctattttgggagcttggaattaatgttagtaataccaggtaaatctagatgatttaactgggaagtcaggaacttcttactgcgtgatttttgtttttgttttcaaataacattgcctcttgtcttccttttttctacagacgacaaaaattacagagtccctgtcagttaaaccagaaatttggtttgaaaattgtcagtcacatattaacaaaattatatataagtaattcagggtatcccttggtattaattgttcctgttagtgctagttcttgtataaacttgatgtaagatttagtactagttacagattgaagcatcatccttatagtctaacaaataatattaactcattaacagataactaacaaataatatttatttgaacatttattttttttgggggggaatggattgtcgaaatctgaaaagccttaagactgagctaaatacacatttaataaaaaatttatgcacctgtcctacctgattttttttttattatcttcttatactatttttttctataataaagttattgagttaagaaccagttaaaacttggatagtatttgtaaaatttcatttaggacgaaattagccccttctgtagttggagtaaaattaacagttgagtcttgtaattatgctaacaaactgttgctagtaaatcttatttatgtgaactagtcatatggtttgacatgattcatttgataatatccatattcgactagtagtattttatagaagccctggccttcatcaattctgtgtgtttgtctcattgataagcagtagaattacaaagataggtactttttgagaaaattcctaagagtttcacccagctcttctttgtcctatattgctttcttttccacttctcctctttttttctctttctggatcattttcaactgaacccctctaaaatttcttggtttttcagcatactagtgggaaagggttagaaatagaagcaaagactcagactttagagatcaaattgatgaccctgagcaaaggataattattatattcatattagattaatagcaaaaaggtggaggtttacagcaagctgtattcaaaagaatacccacatatgaactgatggaattctactctctttccacgtctttattctccacaaatccctattgttttgaaaccttgttctttctttcataaaaaaacttggcagaatattcatgttaatcacaatcttttatgacccggtcattttgaactgcatagtaaggttgtatagagaaggaatgagaagttttgcagtgaactcaacattaataaatataaagaaagaaagaaagaaagaaagaaagaaagagagagagagagagagagagagagagagagagagaaagaaagaaaggttatagaaccctaaccttgagctatgaaggaaataataccgttttctccttagtttataagtgaggcctagaaaagattacatatgtgacttttgtaagttttctattgaatctcacatttcagtgttaattagattagctggcttaatggtagacagtaggcgagtaaattagaattaattttgtttgtttgtttgtttttgttttttgtttttcgagacagggtttctctgtgtagccctggctgtcctggaaatcactttttatttttatttaataaagaatgtttagcctatccttggacttctgatcttgtttatcttttccacttgagtgctaaaattatgtgtgtataacactcctagccaattcttttttgtaagcaaaagtttattcattattttcaatcagtataacaactctttcccccaactgttatttttagaagatctgtctcacaagagaatagtcagtataaaagtataaggtactattttttaaaatttgtatgtactaagcaataaataaataataaagaaataaatctacaaattctactaaaaaggaaaaaactccaatatttcttttgctttattttgaatggttttggccttttttttttaacgagaaaattatacagatataaatactaatgagatcccagcttccatttgaacaacaatcctagtgtagaagttttaacagtcttaaaaaaaaaaaaaaacaaataaaacaaaaaaaaaaaaacaaaaaacagatattctttgtaggctgttgtgttggtttattgggtaaagtcacttgccaccaggcttgatgactgagtttaatccacaagacgtaattaactccttggcacatgttttcttctaccaccagcaaataaatggcacatttttctcctctttttaaaaaataaagtgatttcaaggatatagcatatataaaatcttaaaacctttttttaaaaagtggaataagatcagatgtatccagagacagtattgccatgtgcgagatgctttagactgcgttcacaatctaaaagcagaattgcccagaaaataaaaacacagcaacagaatttaaggtctggacttttaggagttcagactaagaattctgataggaaaaaaaaaaaaaaagaattctgatatgaaaatgtagtggtctgttctttacatgttttggtacatctatgctacaaatcaatatttgggaaacaacagttagtacagtttataagtataaattattgaataatatccatgtgtagaatattgccagtgtttaaaacgaataatgaagtcagtgtgactaaaataggagttgacagtggtatgggacatgaataaatttagttaagttctagaattttccatagttaaccaaaaataattgctaagttgtagaattggaaagaaaagtccaaaaacccaggagctggcacacatcgatgaagaaaaagttgtttgaattacttcctcaatttctctgaaagtctagatgcattgtctagctgagcttccatcatttctcttagtataaatacctattgcaacaagaacttgatttaaaaaaatcatttgacatacattgctttaataatggagtttttctgtgctgctctaggtgtaattcattcattaatagaattgtacttaatgtgatttctcttatttaaaattattctaatagaaattaatggaagccgggcgtggtggcgcaagcctttaatcccagcactcgggaggcagaggcaggcagatttctgagttcgaggccagctacagagtgagtttcaggatagcctgggctacacagagaaaccctgtctcgtgtaaaaaaaaaaaaaaaaaaaaaaaaaaaaaaaaaaaagaagaagaagaaagaaagaaagaaaaaaaaaagaaattaatggaatcctcttccctttatcttcaaaataatttcttacaaccagaatgggagatgaagtagtcagtacgataagagcttagcatcatataataatttaaaagaaagaaatttagagagatttttacttatagaaatgaaagtcatatttagatttttatcaaagtgtataaattactcttcttggagagtctaaacatttttaaatagagctaatttgagtgttgttcaacttaaatagtatcattagtagttttttgttttcagttatgttaacataggattttagatggtaactctggatgtctaaaggttttatttagcctgcctgcctgcctgcctgcctgcctgcctgcccgccttctttccttgtttccttcctttcatgtttatttattttcagacacatcagaagggagcatcagatcctattacagatagctttgagccaccaagtgtttgcttggaattgaacttaggacttgaaagagcagtcagtgctcttaactgctgatacatcatccctccagccctgtctaaaggttttaaatgatggcgctaaatttttttttgatccttgaagatatggttatagaatgtttttttttttttttaaatcagtatatcattctgcttagatttcttggaatgctctcctataaggtcagcttgtaaaaaatgatctctctaggattttgtattgccaaataaattaagaataatattttaacagttgatgagagtgagatttcctagtatgaagagaagtacagttaggaagtgatagttactattgtacattaatacagcatagtaataccagtgtattttttctccagcgctatctatgaagccaatactacctattttgtcttatatttttttcagaattttaagtatatcccaatagttttcatgtatccaattacatgtaagacagcttgattttacaaattcatttttaaaatataactttaatttttttttttatactattctttagttgatgaaacaatggtttaagggtgtgtgtgtgtctcttctaagagttacatttttgggcgggttgtattttgagagggtttatgtagccctggctgtcctggaacttgctcgctctgttgactagtctggtctagatctcagagatccacctgcctctgcctcttgagtgctgagtttaaaggcttgtgctaccacctctcagcaagagttactatatttaaggaaaaaaaaataatgtgactttctttgctaatggcttttgtgtatggttagtattaaattttatgttttgttttgttaccatagtttttaaaaagacaggctactgatgcatcatctcaaacaaaataagaatttacaaagtcactttggcaacattgagaatggtcttcttaaattgctagttggacattttcacttacagaattaagctgccaactatttttaaattatatacaaatatatcctgattctgaaaataatatgtgaatatagttgaaaatattgatatccaaagaagtcacacaaaatctaaaagcaaatattatctctattttctttggaaaagtaggtaaactgtgggctataagcttgctccctggattaaaacttctcttctgaattactatttcttaagttatttatccttttattacttcaagggactttctgtaaaatggttttagcagcctacttgctaaggagttgtagatatcagaacaattttaattgtaaagtgagctgtaagtttcataatttgttgctgctgctgctcttattccgggaatacttctgtttttaaaatcatgtggttaaatattctagcaaaactggaaatacttatttacttgttatcatattttagatagagaatcactataaagctctcactggactcagattttctgtgtagacataactgcactaaacttaccgagtttgagtgctgggatgaaatgcttgttctatcatatatagaaaacatggaatatttaaaaattactagaatgacaatacttgcaacttcaaacttagagttaatggtagagcattaatttacacacttcacttatttatttgatactatctcattatgcttattttacatttcaaacgaaagcaaaaatatagaaaattatttttagtgatcataatagaacatactagaaccagaattgggggaaaagggtagagactggacagatgtatgctgtcttgaaaccaacaagcctttgaatcaataattaacatgttttcttagcaagttgagaactgggagaaaccacagtaataatagtatattgtgttgggaccaaatttgagctaagatgatcatggaaatttaagtgtacaaagttattctgtcttagaacaggtttctagctaatgctgttgttggtataattttgttctccatttctaaggttaaattcaaatctatatatttggctgtaaagtgtcagacctacctattaatttcttggggacataaatttatgaattttaaaagtctatagttttgaagggtaatatgttaacagttttgctccttagaaatgatatattaagcatataccattagagtaggaagaatattacctctgtttctgtaatacattagaaaataggattgatttattgaagcttagtaattaaatgttaatatttagtggtgatatgtggaacttgtgaaagaacagtttcttatatgttcaccaacaaagtactgctgaaaataaatttcaatgaatactgacctgaaaattgggtatgcgagctgagaaggtagatcaacttgcaagaagaactgagtttaatcttcagaactctattaaagaaaagaaacttgaagtgggcattgtagtcctgatgctaggtaggcaggtactggcagagatgccaggggccattgacagtccaacctattgtgttatgcagtcttccaggtcaaggagagatcctttcctgacaaacaaggtggacagatcctgaggaaatacatcttaggtggaaggagacatgtgaatatacatacatgaagacatacaaattagttaaagtagaccaatatagagattctttacagaataaattcataggcccttagacccctaaagatgaagatatacaggacataattgcaactattccccccaccccacccccaacagcattttggctatatcctttactaagaaatgcatagcttcttaaacacagtacatactcttgtgtgttgaaataaatcttgccaaaaactgtaagtcagtttgctttttttcttttcagaaacaaaattcattgttttctttccatattgttttgttattgctgcttcttattttcttctacttatatcttacatttttcctcttctcaactgtcctcttttttatattttcaatcaacagctagagatgattgctatggaaaatcctgcagacttgaagaagcagttgtatgtggaatttgaaggagaacaaggagtagatgagggaggcgtttccaaagagttttttcagttggttgtggaggaaatttttaatccagatattggtaagtattagtgatatgattatgatggtgtgttagtcttttaaagtataaacttggtttataaatattttcagttatggtaagcagtaaaaaaattgagtatgccatatccctgcttcaggagctgttctatcactcacttaatttaggttcttccatatattacttagtcaaatattctagtagaacacagttgccttctagggaaatttaatttgaaaaaccttagagtggtagatttgaaaacctgaagtcatgagaatcataggttatataatttatcctctggttaatttatagcttaattgtccttgagaccaagagcatccattggtgacattctatcagatttattatttgtgaactggaacttttgatattacctggatgtataacctggcatgcaaatgatacagacatacataactcacatttttcaagctggaatgcaagtatgaattgaatacttgtgaaaccagtattccacaaatattaaattgcaagaaaaagcttagacttaatttatattactacagttcaaggagaaaagtgtacttttctttttaattaaaactgaaagtgaaaataaggaaacattttaaatattaaaattaacctgaaagtacattttaatgctttattatttgttttttaatactcttgttccattagaaaaacatttcccaaaactttttgatttgctcattttgattttggcttttttagacaatctttttatattgtattagtactctaaccttaagctcataattttccttactcattttaccaagtgctaaggtatacagcccactctctcccccagcttgttagactttgtataaaaagtatttcctgagaagcaactgaaaataaacttagaaaaattgaaaggcatatacaattagttttgttttattttattgtttgatgttccgtaaaaaaagaaaaaaaagactatctcttaatgttcacctagataaaataatgatgataggaaaaaaaatctctggactttggctttgaataatgaagatcatgtgaagctgaaagatcacaaaatattttttaaaattatattagcttagatttgatatgaattttaagtaacttaaagttaatcaactttctccaattgttttttttttttttacttaatcatgcatttgtttcatatgtaattttcagtcattaagtggataaaatgacttttaattatttctttataggtatgttcacatatgatgaagctacgaaattattttggtttaatccatcttcttttgaaactgagggtcagtttactctgattggcatagtcctgggtctggctatttacaataattgtatactggatgtccattttcccatggttgtatacaggaagctaatggggaaaaaaggaacctttcgtgacttgggagactctcacccagtaagttgtccttcgttaatagtctttaagattgtatctaaatacagaagtttatctcagtttatataggaacattatttatttgtaaacttttgttgatactgctgtttagtaaagtaaaatacttttaatctggttaagtataataaacatcattttttatatatcctatcaagtatgttttgattgaccccataaaaaatgttgaaaacatcatgttttcaatgtcccatatgagtctatgtagtaaagttgttgataggtacagttgatatgtgtgtggcttttttgttgtttgttttcctgtttgtttgtttgtttgtttgtttgtttttcctcatttcctgtaccctgccacaatcatggagagaaagtgtatattctagaccatggtatgaaatctgttgctgaactgatcatttgaagaatttttaagattgacccattgcctgtgacaacctttctatcttattaaactacttgagagatgtggaatatttatggcttcatttttgttgacaagttgtttctacaaagaatgaacaatctattatttttatttcttttagtatttatttggcaacctcacttctctttctggttgttaggttttatatcagagtttaaaggatttattggaatatgaagggagtgtggaagatgatatgatgatcactttccagatatcacagacagatctttttggtaacccaatgatgtatgatctaaaagaaaatggtgataaaattccaattacaaatgaaaacaggaaggtaattaaatttttgtcattgttttataaatatataatttcaaagcagtaaagttttcaaagaattacctagtatggtttgaagcagttataaaaactttacataaacaaatttatctaaatagtaaagctacactttcctcttagataagagcttatgtgattgtacagaattgttaattcccctttagagaaagactaaacagactacaaaagattgaatgggtaaatattactataatgtaacgctagaaacagggccttaccatattaaacctaagaggtatacagagcccagtgattgacatctggtttagtgtgtatatacattttccatttgagatctaattatgcatatcagattattcacattagatttggtttttactaactttaaaagctatttacttggcaataggaaataacttagcttaaaaagaaaatattacatagtataattttaagaaatatattaatttatacttatttttggtgaaatattgtactgtcatgagatctaattatgcatatcagattattcacattagatttggtttttactaactttaaaagctatttacttggcaataggaaataacttagcttcaaaagaaaatattacatagtataattttaagatatattaatttatactattatttttggtgaaatattgtactgtcatgatacaaactacatttgtactataacaaattttataatttgtaaagttttcaaagaattacctagtatggtttgaagtagttataaaaactataaaattttataatttgttataatagcttagtttaccaacaaataacatttttgctgagctggatacagtagctaacttaccagtaccataatttccagaggaaacctgagacattctggttttctcaagttcagtattcataacaaatttatattgcatactagaggttctgttgttatatatatatacagtctttttaaatcttttattttaatcttactgtttacattatttcattattattactattaattacattttatataatttctctttgatttactcatagaatcataatgtataactatgcatatgaatacaacttttatatctgtcagaagtgagaaattgtgaaaataattttctttgtacatataacatgtgattaattttttaagacttatgtttattcttcaagagttgctaatgcttttttaagcactgaaccaactctctgaaatctaatttttaaacatagtaacaaaaaaaatactgctgaaggttttcttggggtggagggtgggtattaaaactagtccaaaagctaattgtgtttcatttgtatagaatatgctttcttgttaatattcctacaggaatttgtcaatctctattcagactacattctcaataaatctgtagaaaaacaattcaaggcatttcgcagaggttttcatatggtgactaatgaatcgcccttaaaatacttattcagaccagaagaaattgaattgcttatatgtggaagccgggtaagaaagacatatacaaaaaaggtcttttttttgtttgtttgtttttgtttgtttttttttttgttttgggtgttttgttttgttttttgttttggtgtactatggatgttaaggtgcttttttttccccctataattttcagaatctagatttccaggcactagaagaaactacagagtatgacggtggctatacgagggaatctgttgtgattaggtaaggtgtttaattcttaaaaaggaagattttattcatcaaacatgtagatgtgtgcttttgtgtcctgtatctgtaggtactggttaccaaacaagtaagctcaaaaatagacctgtattaatatttccaattttcatgcagtctaatgctttatttcatgaattaaatgatttaagtctcatattttctcaaccctttgccttatttttggtcatgtgtaagatggcacattatttagtctttaagatacttgggaagaaccatgtatactagtgattctgaacaattcttaggacagtattaccactaacatcgttctctagtcaaatgcccttatttctacttctgtaatatgctactatccaattctgaaagatctttccccccatcttctaatgtgactgatcaaaatgcagagtagtctttttggcatccactatgatgtcataggtatttaaacagttatctttttgtagatcacttgagctataagactcaaatatgttaacaatagaatgaatattaactgtgtctagtaatgatacattatcattgttatatttatattacagtattactttattcatttaagtttgtagaagattactcttgctttgcccttttttttttaatagaaaagcaaatatgttatttattcagcttttaggtaattaaataacaaaattcagagtaaagcaaaacaaaaaccataacatgtcatatgatatatcatttctaagcacaatggcaattattaatgaatataaaaatttatcattcatatttgcttctaacaccagtcacaaaagtggcaaccattatattgctgctcagttttaaaggtaattcataacagggataaacatggtaatacagaagccttaatgggaatatcctagtattatctctacaatatggcaaaataatgttttagattgattatgattaatgtatgcattttgattattatccttttgttattggcaatagaattatcatgacagtggggctgttacaaataaagttttcattcttagtgttgaagtgttttcatttctcctgaagaagcactttggaggattgtggttgtgaagtaaataacatttttaaccttaagaagcactgcaagaatgcttttgtaaaatgatactgccattttacctaagatgacaagcagtgctagaacgtattctgtatctcttttaatctttggtcatgttgtcttggagtgtgaaataaaattttaccttagtataaatttgcttatcactgatgactcaggatcatgagctgtcttttaggtatttatctttttttaaaatatttttattacatattttcttcaattacatttccaatgctatcccaaaagtcccccataccctccccccctcaacttccctacccacccattctcatttttttggccctggcgttcccctgtactggggcatatacagtttgcgtgtccaatgggcctctctttgcagtgatggccgactaggccatcttttgatacatatgcagctagagacaagaactccggggtactggttagttcataatgttgttccacctatagggttgcagatccctttagctccttgggtactttctctagctcctccattgggagccctgtgatccatccaatagctgactgtgagcatccacttctgtgtttgctaagccccagcatagtctcacaagagacagctacatctgggtcctttcagcaaaatcttgctagtgtatgcagtggtgtcagcgtttggaagctgattatggggtggatccccagatatggcaatcactagatggtccatccttttaaccattactttgtgaattatcttccccactcttctttccactgattatgaactatttcttttggaatgtattctttttaaaggatcatatgcaaacatgttatacatgtgttattctagtctgcagctttctttcccccactgaattttatttttgttgaaattgagttttgtgtgagttacttctagacttggttcttctctgcttattcatttgttctttgatcaaaatcacatcttgatgactcctttaccttgatagaacaaagagcaagtctttatatcagatggtgagaatccctttactttttcattgttcttaatgttttcactaattttacttccatgtaaatattaaaatctgtttgctgaattttacatgaataacatttatttttgatgttttgatttgggttgaattgattggataaatcaatttgagaattgtcattttcatcactttggattttctaaatctcaagcatggcatagcactttccatttagttataccatagtttcatccagcattgatttgtaatttttgtgttgaaataatgtatgctttagtgaataagtttaaataatatgtttcttatgcattatttcattgttcatttctgagaataagcttataattactttcattgctttaaaagccttgtcagtaaaattcaaacaattttttaatttctgttggcatgagttgttttaatttctttgttcttggcatgatagtttccgttttattttttgagggctttcttaaaaatggattgtttttccatataatatatttattgttttccctgtcctcctaccccttccagattgcctacacctcccctcccatctgctccctgccttttctgactcttataaggaagcaaacaagcatcaaggaataataaagataaacaaacaacaaacaaattaggataacgcaacagccaagcaagaaaaagaaccaaagagaaaaatttctagatgattctatagatgtagagacacacatatttgtgtactagagaatctcataaaaaatgcaaaactcacaaaactagaagctctaatacataatcagaggacctttaagatatgggggggagaaacaccatgaattaacattatgagaccaagaacctctgcagatgccattgtgttggtcaactaactgttggatatgggccccacacataagaatggcatgtttctccagtgagactcactctctctctctctctctctctctctctctctctctctctctctctctctccccctccctccctccctccctccctccctccctccttcctgtctttgagtagaggaaaactattcctcagctatttgcatgttggcgaatatatacttcatgtagcttcttgccagcttctttttgctggtacttctaacagtacctcagcctatgtggttatctttgtcttacctagggtctctaagactcaaaggataggagagcacttcagggcaacaactattcctagcagaactttgcccatagcccattaatactgtatatttgaaccatggtgcaacttaattgctttttgaatcttcatagttttaatctttctattttaggtttgtaaaagattgtaaaattgtctatattcctagttgtgtatagttttgaatttatctctagtttctttgtatttgttataatttttaaaatttatttctaattgaaccttatttctgtcacattttttcaaggttcctctctgttaaggttttctaaacttcatttctgatctagttattgttttcatagcctttattttagaattttagtttttactatgtatttctaattttcttgtctttatagttttcatcttttgttgatattgacaaagttttcatgattatactatttaataaaattgtgtgttttattttgattcctatttttgtttcttattttttaaaataacattactatatgtttatactgtaaaataaaattctttcagttaattaaaatacgaaacaactcaacaatagaaaataggtaattaaatacttttaaaaataacaattctttggtttttgatttgattttattttttttttgtatgagtggcctgcatacttgagtctatgcaatgtgtgtatgcagtgttcactgaggctagaggatggagttggattccctgacactggaattgagccatcatataggggttgtgaatccagcctggatcctctgcaatagtagctggtgcttttagccaccgaataagttccagccctacttctaaaattttaaatgaaaagttgtgtcagttttgcctatgtctaattctcttagatcttgaggccttattatgttgaaaatcttggcttctacatgcagtacagatacagttttttttataatgtatccatcagggtcatatcatatatttgtaagtattatatattatacgtgtttttaaaaataaaatctttccttggctttttttgttttgttgttgttcttatccatgcttctttcccatgaaaagaatgatagaccacttcatcactatatcttcttcagaaagactttgaaactataacaatcaaaattacatagtactactattaaaaatcggccattcaaagggaacagttccaaatacattgtattttatgttagaataatttttgatgtaaaagctcaagtaattattcattcaaaatatatatatttcaattgctataaacgtggaaaatccacagtctattttaggttttgacaagagaaataaattttgcatccttgacaaacaaaacttctacgcaacatagtgattatcattttcatttgtagaagaatgttctttagttcctcttctataaagaggaaataagccaacataagaaaacagaacaaaacaaagcaaaaaaagaagtgttacctctggtccccccccccctttttttttgccactttacagaatagatgtctatactaagaaactttaagtaacagggagaaaggaaagaagacctgctgctgtgtgctacaaaagagaaaaatgatttgttccatgcctgggagaaaacatgttaatagattaaaagatcagggatcaattagttcttactttctatagtaaaaattgagctattaaccaactaggtaacatttgtttttgtttggtttacacacacacaccttcctccattttctggtaaattccaataagcttctttcaatctcctccaaattctcctccccgcattatttctcccaccaatcaccttgtaatttcgggcttcaaatctcctgttactttaaatctaagtggggcacttgaatagttggtggatatttttataatggcttgttgaactacttagctcctggtttggtttgctcttcatctttcatagggtagtaattcataatgctactgcccttctttctcctcatcttttgtagtgctacttcagttcttttttagttcaagttaagtttattggaaataactcttgttcttcagttctttgtgccatatcccctttttaactattcattcaaataggttttcatgttcacttttatcagtaaatggagcctaatttttcttttcctggcatgctctggaaccattgctatatgaaagttttccgcttttttttttgtttttgttttgtttgttttttgtttttgtttcaaggtctattagctgtcctttttgctgttcttttttgcatttctttttcaacgaactgttgttttttttttctttcaaaaaatttttttaattatcagtgtgaataaaatcaccattatttaatgtgattaattcttcatattctctgttcaattcaaaggttttcattttctttcttttttactattttttgtcttagtttttgtcctagcttctttattttttttttttttccattttttattaggtatttagctcatttacatttccaatgctttaccaaaagtcccccttacccacccacccccactcccctacccacccactccccccctttggccctggcgttcccctgtaccggggcacacaaagtctgcgtgtccaatgggcctctctttccagtgatggccgactaggccatcttttgatacatatgcagctagagtcaagagctcaggggtactggttagttcataatgttgttccacctatagggttgaagatccctttagctccttgggtactttctctagctcctccattgggagccctgtgatccatccattagctgactgtgagcatccacttctgtgtttgctaggccccggcatagtctcacaagagacagctacatctgggtcctttcagtaaaatcttgctagtgtatgcaatggtgtcagcatttggaagctgattatggggtggatccctggatatggcagtctctacatggtccatcctttcatctcagctccatactttgtttctgtaactccttccatgggtgttttgttcccacttctaaggaggggcatagtgtccacacttcagtcttcatttttcttgagtttcatgtgtttaggaaattgtatcttatatcgtgggtatcctaggttttgggctagtatccacttatcagtgagtacatattgtgtgagttcctttgtgattgtgttacctcactcaggatgatgctctccaggtccatccatttggctaggaatttcataaattcattctttttaatagctgagtagtactccattgtgtagatgtaccacattttctgtatccattcctctgttgaggggcatctgggttctttccagtttctggctattataaataaggctgctatgaacatagtggagcatgtgtccttcttaccagttggggcttcttctggatatatgcccaggagaggtattgctggatcctccggtagtactatgtccaattttctgaggaaccgccagactgatttccagagtggttgtacaagcctgcaatcccaccaacaatggaggagtgttcctctttctccacatcctcgccagcatctgctgtcacctgaatttttgatcttagccattctcactggtgtgaggtggaatctcagggttgttttgatttgcatttccctgatgattaaggatgttgaacattttttcaggtgcttctctgccatttggtattcctcaggtgagaattctttgttcagttctgagccccattttttaagggggttatttgattttctgaggtccaccttcttgagttctttatatatgttggatattagtcccctatctgatttaggataggtaaagatcctttcccagtctgttggtggtctttttgtcttatagacagtgtcttttgccttgcagaaactttggagtttcattaggtcccatttgtcaattctcgatcttacagtacaagccattgctgttctgttcaggaatttttcccctgtgcccatatcttcaaggcttttccccactttctcctctataagtttcagtgtctctggttttatgtgaagttccttgatccacttagatttgaccttagtacaaggagataagtatggatcgattcgcattcttctacatgataacaaccagttgtgccagcaccaattgttgaaaatgctgtctttcttccactggatggttttggctcccttgtcgaagatcaagtgaccataggtgtgtgggttcatttctgggtcttcaattctattccattggtccacttgtctgtctctataccagtaccatgcagtttttatcacaattgctctgtagtaaagctttaggtcaggcatggtgattccaccagaggttcttttatccttgagaagagtttttgctatcctcggttttttgttattccagatgaatttgcaaattgctccttctaattcgttgaagaattgagttggaattttaatggggattgcattgaatctgtagattgcttttggctagatagccatttttacaatgttggtcctgccaatccatgagcatgggagatctttccatcttctgagatcttctttaatttctttcttcagggacttgaagtttttatcatacagatctttcacttccttcgttagagtcacgccgagatattttatattatttgtggctattgagaagggtgttgtttccctaatttctttctcagcctgtttattctttgtgtagagaaaggccattgacttgtttgagttaattttatatccagctacttcaccgaagctgtttatcaggtttaggagttctctggtggaatttttagggtcacttatatatactatcatatcatctgcaaaaagtgatattttgacttcctcttttccaatttgtatccccttgatctccttttgttgtcgaattgctctggctaatacttcaagtactatgttgaaaaggtagggagacagtgggcagccttgtctagtccctgattttagtgggattgcttccagcttctctccatttactttgatgttggctactggtttgctgtagattgcttttatcatgtttaggtattggccttgaattcctgatctttccagaacttttatcatgaatgggtgttggatcttgtcaaatgctttttctgcatctaacgagatgatcatgtggtttttgtctttgagtttgtttatataatggattacattgatggattttcgtatattaaaccatccctgcatccctggaataaaacctacttggtcaggatggatgattgctttaatgtgttcttggattcggttagcgagaattttattaagaatttttgcatcgatgttcataagagaaattggtctgaagttctctatctttgttggatctttctgtggtttaggtatcagagtaatagtggcttcataaaatgagttgggtagaataccttctacttctatcttgtgaaaaagtttgtgcagaactggagttagatcttctttgaaggtctgatagaactctgcactaaacccgtctggtcctgggctttttttggctgggagactattaataactgcttctatttctttaggggatatgggactgtttagaaggtcaacttgatcctgattcaactttggtacctggtatctgtccagaaatttgtccatttcgtccaggttttccagttttgttgagtatagccttttgtagaaggatctgatggtgttttggatttcttcaggatctgttgttatgtctcccttttcatttctgattttgttaattaggattttgtccctgtgccctttagtgagtctagctaagggtttatctatcttgttgattttctcaaagaaccaactcctcgtttggttaattctttgaatagttcttcttgtttccacttggttgatttcacccctgagtttgattatttcctgccgtctactcctcttgggtgaatttgcttcctttttttctagagcttttagatgtgttgtcaagctgctagtatgtgctctctcccgttttttcttgaaggcactcatagctatgagtttccctcttagaaatgctttcattgtgtcccaaaggtttgggtacgttgtggcttcattgtcattaaactctaaaaagtctttaatttctttctttattccttccttgaccaaggtatcattgagaagagtgttgttcagtttccatgtgaatgttggctttctgttatttattttgttattgaagatcagccttagtgcatggtgatctgataggatacatgggacaatttcaatatttttgaatctgttgaggcctgatttgtgacctattatgtggtcaattttggagaaggtaccatgaggtgctgagaagaaggtatatccttttgttttaggataaaatgttctgtagatatctgtcagatccatttgtttcatcacttctgttagtttcagtgtgtccctgtttagtttctgtttccatgatctgtccattggtgaaagtggtgtgttgaagtctcccactattattgtgtgaggtgcaatgtgtgctttgagctttactaaagtttctttagtgaatgtggctgctcttgtatttggagcatagatattcagaattgagagttcctcttggaggattttacctttgatgagaatgaagtgtccctccttgtcttttttgatgactttgggttggaagtcaatcttatcagatattaggatggctactcctgcttgtttcttcataccatttgcttggaaaattgttttccagcctttcattctgaggtagtgtctatctttttctctgagatgagtttcctgtaagcagcaaaatgttgggtcttgtttgtgtagccagtttgttagtctatgtctttttattggcgagttgagaccattgatgttaagagatattaaggaaaagtaattgttgcttcctgttattttagttgttaaaggtggcattctgttcttgtggctgtcttcttttaggtttgttgagggattaccttcttgttttttctagggcgttgttcccgttcttgtattggtttttttctgttattatcctttgaagggctggattcgtggagagataacgcgtgaatttggttttgtcgtggaatactttggtttctccctctatgataattgagagtttggctgggtatagtagcctgggctgcagtttgtgttctcttagtgtctgtataacatctgtccaggctcttctggctttcatagtctctggtgaaaaatctggtgtaattctgataggcttgcctttatatgttacttgacctttttcccttactgcttttagtattctatctttatttagtgcatttgatgttctgattattatgtgtcgggaggaatttcttttctggtccagtctatttggagttctgtaggcttcttgtatgttcatatgcatctcattctttagatttgggaagttttcttcaataattttgttgaagatgtttgctggacctttgagttgaaaatcttcattctcatccactcctattatccgtacgtttggtcttcttattgtgtcctggatttcctggatattttgagttaggatctttttgcattttccattttctttgattgttgtgccaatgttctctatggaatcttctgcacctgagattctctcttccatctcttgtattctgttgctgatgctcaaatctatggttccagatttctttcctagggtttctatctctagtgttgcctcgctttgagttttctttattgtgtctacttccctttttaggtctagtatggttttgttcatttccatcacctgtttgtatgttttttcctctttttctgtaaggacttctacctgtttgattgtgttttcctgtttttctttaaggacttgtaactctttagcagtgttctcctgtatttctttaagtgatttattaaagtccttcttgatgtcctctaccatcatcatgagatatgcttttaaatctaggtctaggttctcaggtgtgttggggttccctggactgggcgaagtgggtgtgctgggttctggtgatggtgagtggtcttggttcctgttagtaagattcctccgtttacctttcgccatctggtaatctctggagttagtagttatagttgactctgtttagagattgttcttccctagcttctttaaaagtacacattgctttaaatgtcatgtttcttcttaaccttgagtcaatattcctgtccttgttgcaatggttcttcagtccgtgtattatattcttttgtttgtttgtttgtttgttgcttttcaagacagggtttctctgtgtatccctggctgtgctgggtagaccaggctggcctcgaactcagaaatctgcctgcatctgcctcccaagtgctgggattaaaggcgtgcaccaccacgcctggctcgtgtattatattcttaatttgctcaggtccaattttcttttctttctttcttttttttttttttttttttttgtaaaagcacattctgctcatttctacatggtcattcctcctcggttcttttgagtttttttctgattttctttctccattttagtcaccttcaagactgaatctttttgttcttagaagagtctcttgcttattatgaggagaaacatttcttttgtgaaatattcatactttctctatgtcatttgaggctttgtacatttttatgttctcttcagacacatcagaagagggcatcacattcctttacatggtggctcatggttgtgtgatttgtgggatttgaactcaggacctttggaagtgtagtcagtgctcttaatcgctgagccatctctccagcccggctttgtacatttttatacccatccagttcataatccatccatcattaaggaaacttggagcaggatccattgcagcactgcttgctgatttatgttcctctaactccctcctcatttttttaaaaagagaaataattctgtctccttttcagaagactaaaataaacaaaacataattgttgacctctcattttcctatctaaatttgctctgtttacagagattgtggagcagtaacaaaattgctgtgatcaatagtcctttgccttgtatatcttttttgtctttccttaattgatgatttcacctgtgattataaaaatggtgatttaaggaaataattttatctagtcatctgacatatgtcattctcctattttcctatctttttcatatcaactattatattgttaccttaagatatcaatctattgaaaagacaaagtcaaatatatttaagattgatactgaagagataatatggtaatttttttgttttcagatattatgaactcatgaatttacttttaatgtagtaaatgtgttttaccattaggactttagccttgcttaggactttgcttggtgttggtgtatctttaacatgacacatgactttgttaaaatttgaaattttgccttatcttgaacattatcccctaccctgtaagaaaacattgttaaaagaaattattagaaaactgcatccaggaataagacttactatttaatgttatgactggtaaggccttgtcaaggaacaaacctagaaagaatcttttaagtatattatcaaaataatcccttattaacatagaggttactttgcaacttttttgctctcttccagctgtcacataatattgaagtatagttttctattttcaaggtcattatattacctaatcatatttttaatattgtctcttactcattttattgttcagttattgatccccctcacacccttcttttgaacaatagcttgcttgtagcatagcctagcctagaacttgcctaccttttgcctcaaccttcaaaatgctgaatcataggaatactttttagatttcctttccctttgccttttcttgtacatgagagacatttgtctctggagtaatttacagtattttctctacattaatgtcatttatctttacttgttagggttttttaccaagtgaaaggttttagtcaattaacaatttgtttccattttactttgatatgcatttcttcagttttgaatattttgttttaactcctttccccttctgacttcctaaccctttgcttgctttttgtttctagactgttgtcaagtagaaatgttggatgtttgtcaaatacaaattactacacttccctcatttacttacctcatttttgaatcatcttttatttctagagttgatgtgcatttgcctcagaattttcttttttctttttaagaattatttatttattttatgtatatgggtacactgtagctgaacagatggttgtgagccttcgcatggttgttgggaattgaagttttaggacctctgctcgctccggtcactctgcttactctggcccaaaagatttatttattataatacataagtacactgtagctgtcttcagactcgccagaagagggatcatctcattacggatggttgtgagccaccatgaggttgctgggactttgaactcaggaccttcagaagagcagtctgtgctcctacctgctgagccatctcaccaacctgcctcagtattttcaagtgttattatttctgtttgaattcattaatctctttatttttgattcatgatgccatcgttaaacttttcatgttagagtttatattattcacgactcagtcttttttaaaaatagtttcatattccaaaaagccttatttctcatttgaagaactcttcataatattcctattggacttaaatttattttttatcatttacttttttatatatttcctcccatggacctgctcttagtaaatgtcatggggtagcaaagcatagtacagtcactttaagtggtttctcaatgaaggaaaaccttttactgctgtttctttaatatttggttctgctttatgtgattcaatgccttctacttttcacttacaattttttaaaaattaaaatcccttcaccaggtatttctatcatctttggaaagtttcgtcacttctttcttccgctcttccagtgtctacaatttttttgtcctattctgatccttaactgtgcttatcttgtgtattatttctctctacttttactttggggatttattacttgattttccaattttattctcagcatagattacagatatatttattgcacatttctcttgctttggagaagatcttgatagatttttagattgaggttttagaaatgtgaataggatattgaacatgtattttttacaaaagtaaattttaaaacatcacgcttagcattaggaatacaaaagtactttttaagtagaattactgagcaaaagagttattaatatttatcccatatatagttcctacaagatataaaatctggctgactaaaacttacatactaagtgtaaatggtacttttaatattcactgtgacattggccttaatgttgtagtactatgatcttgtttatagtggatgtcaaattaaaaccagtattctcttttcacattagggagttctgggaaattgttcattcgtttacagatgaacagaaaagactctttctgcagtttacaacaggcacagacagagcacctgttggaggactaggaaaattgaagatgattatagccaaaaatggcccagacacagaaaggtaatatcaaactccaactttgtacccactgtaaaccttttcaccatattccatacacgcaagcagagccaacatgtagcctctatatactcttctgatgttatattgaaatatctaagtcagcaaacactagtggaatggatattttcccttcatgatttgaggaatttttttaaaaattagtgtagttaaaaagtaattatggagcttacagaagtacagacgttatcaagttgttatgttttattccccctttgtttcatagtttattaagaaagccttattatagaacagtctactttgaatggctacactaaaatttagaggattgtctgttcttttacattatactagattcttattctagggttaaatcattctgacttttgattgtattctttctccaataaatacttcacaattttatggtggggctgaacaatatgtcctaggtagacttcgatatacatcgacagatatatttttattactgttaattagacattttatacatcttggctctaattttaattaatttataatcaatcattatcattttcattttgccagcagtatttcaaatctatatacagagcatagacttcaaaatctttaaaagccaggtttgaataatttttaatctttggtgtaagttgtttagtgacttcagcttttaatgggtttagtaagatgtttgttgtgtaaagatttaaatgaacttcagtgttaaagtatctaaagcaataggtaacagagtggaaactcaatagataataaatgttactatcatcagcatcactttaatttttgcattatttcataggataaagacccaactgatctttttaactaaacagtacaatgtttatgatatatttaatctgtagtttctcattaaaaaccgtcctaacaagatatgtatctaataggagcatttaacactgagcatatttccaatgactcatgattgtcctgtttttccctttctctttatttaggttacctacatctcatacttgctttaatgtccttttacttccggaatattcaagcaaagaaaaacttaaagagagattgttgaaggccatcacatatgccaaaggatttggcatgctgtaaacaaaaagaaaaagaaaaagaaaaagaaaaagttaaaaaataaatataagagggataatttgatggtaatagtatcccagtacaaaaaggctgtaagatagtgaaccacagtagtcatctatgtctgtgcctcccttcttcattggggacattgtgggctggaacagcagatttcagctgcatatatgaacaaatcctttattattattataattatttttttgcgtgaaagtgttacatattctttcacttgtatgtacagagaggttttctgaatatttattttaagggttaaatcacttttgcttgtgtttattactgcttgaggttgagcctttttgagtatttaagatatatataccaacgaaactattctcgcaaggaaaacattgccaccatttgtagaacatgtaatcttcaagtatgtgctattttttgtccctgtatctaagtcaaatcaggaacttttttctaacaatttgcttttgaaacttgaagtcaaggaaacagtgtggtgcaagtactgctgttctagcccccaaagagttttctgtacaaaattttgagaaccaataaagatggaagggagaacttggaatgtttgaaccacagccctcagaactttagtaacagcacaacaaattaaaacaactcatgccacagtatgttgtcttcatgtgtcttgcaatgaactgtttcagtagccaatcctcttagtatatgaaaggacagggattttttttttgtttttgttgttgttgttgttgttgttgtttttgttgttgttgttgtttttgttgtttaagtttactggggaaagtgcatctggccaaatgataggatagtcaagcctattgcaacaaaattaggaagtttgttgtataaataagcatgtaaaagtgcacttaaaatgaatctttattattgctgagattttaatagacaatccaaagtctccccttctgttgccgtcatcttgtttaatcaaccatttttcaaggcactcgatcagtgttgcagcataacagaaagtacagctactgtgccttgtgttacttatttacacagttagcaggcctggaaatgaatggaactagtactcctgagaaataaattgtatatcccccaaattaaaatttacttcaaaggtgttaaagatttcatgtcctatattaaagtacaaataggcttaaattactggatatttaatgtagtttcccatccctagtcttctatgtctgtgatgttaatttcttttgttgcataacaaaataaaagaattatgtatttttaactaaggagagacatactggtatatcattttactacaagctacagataacctgttgagcttgtgccttgattgttttaacaactagtgcaaatcaacctgatgattttaattggcaggggataatggtagctttcaaatcattggaaggggaaaaggatgtcttaggattattttctttcttgtagtagttgagacagagctcttatttactgtaatgctaaatgaaacagtggcttaaatattttaatgggaaaagagaacacagtgcgttccatattgtgataaggtaacgtgaggtttttttgttttgttttgttttcttttttttttttctgagctagcctttagaacactgttgtggtatgtatgctaccttgattataggaccccctaaatgtgactatagtcatcttaatgggcatcttgtccactgtgcttcttatgtattatgaaagtgataagaagacaaattaagtgggtatattttataaaataaattcatg

SEQ ID NO: 6 - DNA, 101780 bp, Homo sapiens
agccagtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacaggtcagtgttgccgcggcctgcgccaggcggcgctggctcccctccgtcactcggccggccttcggggcccgctgtggcgaggtcgacaccccccttccccgccccccgccgccgaggcgagtgtttgggggcgcgtggtccgaaggggctggtgccagaagtaggcccctggtggccgcggctgctgcagccgtaactgtcagtcctggctgagcgacggcgggagggttttgtcgcccgaggggacgcgagcgggcccggggcggggcgggacgtgcgaggcgtcgagatttgggcctcctaggagccaggctcttcgagccagccggggccccagacagggaagggcaggccctttccttcaaaggggagccctttctcggcgttttcaaggtttttggctctcttggggaagacatatttagccgtgtgcttggtgggttggggttttgggggtggattgatgggaagggagggcggatgaagtggtatgtcaagcccaagggttgtgcgcacaggttactctgtgttaccggccaccaggatttctgaagttgaacgtgagttattggctttgccagagactgctgtgttatatgcagacctgtatgcaagcagttggccttttttccccccccttttcagtgtagaaaatgaaaaggatgctttcctcatcttggtggtaaaggcttttgttggtaaaggtagaattgaatgtaccaaatgccttagtccgtaaaattttagaaataattttaatacagacactggtgaagcttggcaaccttgaaagagaatttagcgtctacattttttaaatgactttttatggatatgctaaattagtaacagtccaaaatctgtttgagattattaagtggcgagggtgctgttgaaaatgtaaactaatagcatatggggtttacagtgcacagttaacctcaatcatgaagaaatgtggatatgacccgtaattttggatcattttactgcctgcaatattgagagaagcagcaaattattacagttttttttgggagacgacctaaagtttaagaaatacaactgttgaaagttacctgtcagagacacaaaggtacccaatcaatcttgttgaataaattggacaagtgggataaggtgtttgtctcacacttctgatcaataagtactcttacttaagaagtgatttggtaaatcatgtaaaatttagaatttaggagagataagaaagttgtaacttggtgtgtatagtggaaatagctttgaaattagatcctgtttttaaatccaagctacttaccacatttttagtgaaatgaatacattattaatgatgctactgataagccctaaggatgaccagaagcccttttaagaaacactaatacagttgaccaaaaaataaaaaaggaaatagcttcaagaaataattttcaatctttgtgtatttataatatacacaggagaaataaaagaacagaatatgaagaggtaacttataatctttacaaaattagaatgtaaactatgctagtcttactgtgtcaatatttattaacctgcattagtttgctaagtagtatgctcactatcctctggacattgcccctgtccctgaggagcttaactttatacagagatacaaaatactgtgttttgatttcctttcagaggatttataagctacttatgttttatctgtcctaaattctgcccttttttttcccatggctgaaaaaataacttcctaagaaaggtacatactagtcagaggtgtggggaaaacgtgttctcatcccacttgtgcagtccatttaacaggatttattgggtacctacagtgtctttgacatgtaacatttaatcagttgtatttcttaaactttagataatttctatttcgatcatttctatttcaatctcctccctctcccctccaaaaaaatttactgtgtaaactgtgataatacactgtttctctcagtgtcagtcagtggaatgatccagatttataggtcatagcaaaatttttcatcccaagctcttgaaatgatgtttccaaatgtccattttcttaaatgactgctagttatgttctccaatcatgttacacatattttgtttagacttataattgtgtaggtctaaatgtagaaacattacattatgtacatatgcagctgctgaaagaaaattagttttctaatttttagatcggggtgaagacaaacttttagaagtgatctttcggtaaaatactggatgaagtcttaggtgctctttttatgttggttcaggacaaaagttttttgactgctttttgagttttcccctcactgccaaatgtaaggataaaatgtagtaacaagacatcttggtatgtatagtggtaatatctttggaattagaccctaattttaattctggccttattaatcttggtaagccacagttttgtcatctgtaaaatgggttggtgaaacttccccagagttgtgaggcttaaagtatgtaaaacgcctaacacgtaggcactcaataagtattaccttagaaatcttcctatccagtttttctgaatggtctggaagcaccttgtatgtagtggactacagcatgttatcctttatgttgtttatttcttttctcattagctatgaactttttaaggccaggaattcctagtgtttaccagagaatgtgttactagatgtcttagtctgttctggctgctattacaaaacaccacagacagcatggcttataaacaacagaagtttatttctcacggttctgggggctgagaagtccaagatcaaggtaccaacaaatttgacatcttagtgagggccctcttcccttgttcatagatagctagctgtcttttcaccattacctcatgtagtagaagagtagacggggctctatagggcctcttttatagaggcattaattccattaatgatggcaaagcttcccaaaggccccacctcttaatactatcaccttggaggttaggctttcaacatgaattttgggggacacattcagaccacagcactagagcaggcatgaattggttattggtaaatcagtaaatgatcaactaacatttattaggttcctcctgtggcttctatgagctgagctaagtacaggacccacaaagacaagaaagatgtctgtcttttttgaatgcttatagttgagtgactttctcacatttgtgtgtgtgtgtgtgtgtgtgtgtgtgtaaaaccctatcacataatggaacttcattttcccatgcccttccaatctaagagcagttctatggactcaatacctcctacccaccagctgctactgtaaagatttacttttttactccttttaaaaagttcaaccctctggcacatgcattacttcattccttggtcccagcccaccaccccagtatctggcacgtagtgtattagtatttgtgtgtgtgtgtgtgtgtgtgtgtgtgtgtgtgtgtgtgtgtgtgtgtgtatgtatatagaatttaaaatttttactccggcagttgtcttcaaatactctaattttggggggcatgattatcattctgtcttctggcagtacatggatagatgctacctgagtaggattgtctatgaggtcagctgctccagtcattttatacaagaggaaattggagtgcaaagctttaaaatgattttcttaaagtcacccaggtgtcagaaccagaaccagagtccatgtctctagttcaggactctgcacacattggcacatgttctgtcctaccttttgggatgaatagttatacttgctttgtgattactcacccacctttttggagacatatgagtgttttgtacactattaatagaaggcagccttcacaaaatgccatctgcagatctgttatttcttctaataaaggaaatgatgtaaaattaccttaaatagaaatagtgttaattcttctggagacatattccataatccaaacacgaaatgtttgaaatacttgaagatgccatataaataagtcctttgtaaaaagataatattaaaaatttttgttttatagagatgggggtctcactgtgttgcccaggctggtcttgaactcctcagcttttactttagcttcccagtgtgttgggattacaggcatgagccacaatacctggccaagtccttttttttaatcaaatgacttattaatacacagtttctttgccagcttttgttttcatttgctatcaaaaatgttgcttagtagtgctttgatctgagttatcaataacaggtaaatgccattatggataataattcaaaaagaagcttattaattattaggcctatctgagagtgaagtaaagttagcattttctttttgtttattttacttattgtttatttgtttagagacagggtctcgctgtgttgcccaagttggagtgcagtggtgctgtcataactcattgcagtctcaggctggagtgatcctcccatctcaccctcctgagtaggtgggattagcatatgccaccatgcctggctaatttttttattttttaatttttttgtggagatggggtcttgccgtgttcaggttggtttcaaactcctggtctcaagcggcttggcctcccaaggtgctaggattacaggtgtgagctaccatgcccagctgagcatttttaaaaaatactggtctttgtacatgagtcgttactatttgattctaagccttatgactgatatccctaaaaattatttataaaattttaagtgcatcagagtcattgaaatggaatgagcactgtcttttggtcttgaggttgttttaactagcttcgtaatggtcatgagcaggttatttagcttttgaagccttcgttccttcttttgtcaaatgaaagtgatagttgctttgttttaaaagagtatgcttttcaaacgtgatcattcttgaaaatgtagattaagagctttttagaggccaagtgccatggctcacgcctgtcatcccagcactttgggaagccgaggcgggcggatcacgagatcaggagatcgagaccatcctggccaacacggtgaaacctcatctctactaaaatacaaaaaaaaaattagccggacgtggtggcgcatgcctgtagtcccaactactcaggaggctgaggcaggggaaacgcttgaacacgggaggcggaggttgcagtgagccaagatcatgctactgcctggcgacagagtgagactgcctctcaaagaaaaaaaaaaaaactttttagaaacgttgttttggggaatttttagtgtgtgaattcattttaaatatgtgaactccatttgacatggacaatggatcttaatagtttgtgatacattattcagtgtattaatcaaaagtcaaatctcttttgtaatttgctgtaccagacctgttgtgttaatctgatcaatggcaagtgaatcataagattgacctgaaaggaaaagatatttttaggggacatagaatcatattggataagattattcctatagttcattttcaggaaatctgaacaggaatctcgtgtaaggaatcacatgtgaattatagaagagagtctgatgtaagactttatttattaaggtctgcatctgtgtttcaagtaagagcatagaggtagtatatgagccctgaacactcatacaagtaggataaaatttttcttaaaactgttggctggacagtgtagagtctaatgctgtgactcttaacagttttgtgtgttccagaagttcatctcctcaggatcaattgaggttagtctagcacagactttagttatagaaaccaaacatgagaaaaattttttgacccatgtcttcgtagcatgcaggcttggtagctctttcctagttctggatgtgtgcccgttgtatatactttcagcaattcaggatgttccttttcatatttaagacaagcactcttgcatacaaattacatagctgtgggctgaatgaagatgctaccattgctgtacttctacacaggttcttttcatgtaatgaaatcagaagggatggcttttccatttcaagcttctgttaataagtagtcttagaattgcctttgtgtactgtagccaacaccccaactcatatatttttataatctttgtgatgcagaataaattctgaaactttccacctcctaattaaatatagaaatactgaaaacaataaagcaccatgtattcactatggacatatgtcacattttgtcactttcttgcactcttgtaatccctctctaaagctcatgttaaactcatgttctttattttcttctcagatgattcctttggcactgcatgtaacagtacaggaatttcttcctttcgtacttccaacaaatacttttttgtctcttaacagatgtgaaccataatgctgttctttagaaagcaaaggatgaagtgcacagcagtgttttctatataaagctaatgggtcataaggggaaatatgggttatttccagcttgttaattgtcttaatacatttttcctaagaattctattgtgcctctgtggttatatgcaccaatattgataatcttacagcgtgccataaataaggatttttatattatctttgctaaatattttaagtttttgttttgggaattgaaaaaatcttttgtgcatctatggtatgtgatacgtatactaatggataaatcctgtttcacacaaagattaattgggtaacatttttctttcctagttttctgaagtcagtggtcatgttgtgtgttggtgattgaaaatatgctgtttaggctgggcgccttggctcactcctgtaatcccagcactttgggaggccgaggcacacggatcacctgaggtcaggagttcgagaccagcctggccaacatggtgaaaccctgtctctactaaaaatacaaaaattagctaggcgtggtggcacacgtctgtaatcccagttacttgggaggctgaggcacgagaatcgcttgaacctgggaggcagaggttgcagtgagctgagatcacaccattgcactccagcctgggcaagcaagatttcatctcaaaaaagaaaagaaaagaaaagaaaatatgctgtttaagatcattcaaattcagtttctaagaagtgtaaagttttcctaattacttaagctgcttcattctcattcccttttgtaacacattttgccatctctgtaacatgttgaacatgtttaaagaacagagtgggagaataggaagttacgtggataaagtttggtaatcaaggtaggaatacatcctgcttcacagaatgggaatatttctgaaaagttgactgtagtattgaagaacacttaagtgtagtgtattagacgaactgagctaattttggtcttttatacacataaatcaagatttctgcatttcaaatcatgcatatttctttaaatttattgctcagtgtactgtatttcaaatattgtaaaaatgaaaagatcttgtggtcttatttaactcagtatgggataagtccttcccaccttcccattcttattccctcttttaggctgaatgaaaggctgggggagtgaatttaaaaatagatggatctcagctggagaatgggttggtcacgtatctcaactgatattaaataatttcttaaatcctggattgaagattataagaaaacagtaaatgtttgctctcagttcatttctttgttttgttttttcatgtacagttttaggcacttgtaactgctggatgcatgaactactttctagttctttcaggcctacttttagatatctgctgtggggacagtcctcaacacttaaagtaattttaaatagtgataggcagaactaggggtcagttttactgcctatgcctgtgctgaatttgacatggcattcctaggaggggaggtggaacgagggcggtgcacacattgtccatattgctagtcagtgccagattttgagaaactggggctaatctctctcttaaatggtcaagatctaattccccaaagtgctgtttcagataacctagtatttgtccaaaattgccctgctacaatagtatttatcttatatatatgtattatatatataatatatatataatcttatatatatgtattatatatattatatatataatcttatatatgtattatatatataatatatatataatcttatatatatgtattatatatataatatatatataatcttatatatatgtattatatatataatatatatataatcttatatatatgtattatatatataatatatatataatcttatatatatgtattatatatataatatatatataatcttatatatatgtattatatatatataatacatataaatatatatatatatatatatataggtttttttttgtttttcctcctgagatgtagtctcgccctgttgcccaggctggtgtgcaatggtgcagtcttagctcactgcagcctccgcctcctgggttcaagtgattctcctgcctcagcctcctgagtagcagagactacaggtgtgcactaccacgcccggctaatttttgtatttttagtagatacagggtttcaccatgttggccatgctggtttcaaactcctaacctcaggtgatctgcctgcctcaacctctgaaagcactgggattacaggcatgagccaccacaccaatcctattacattcttaaaaaaatgtttgtttgtttgtttttgtagagatgaagtttcactatattacccagcctggtcttgactcctgggctcaagtgatcctcctgccttggcgtcccaaagtgctgggattatagacatgagccactgcgtccagcctgtatcatatttttattctgatatcttttgtaattttgtttttagtgaagtagggaggtttatattagataatcttccaaggtaattatcagcttggacattatatgctaatatgtcttttgtttgtttttaaaataagtgtatatgttttaattgtaaaatttttaaaacatccagaaaatgacatagcaagtgcctatttatccaccacctggaaatataaattatgtccatttttatcccttgggggaaaggatgcagttatataatcacttttaacaaccccaactgttcaagtcctgttacccgtctctacacaaagtaacaactgtcttgagattcttaagtaaatttcacatccttgttttatacttttactatacatgtgtacatgtatctgtaagtgatatgtggtgttggtttttgtattaaatttttacagacatgtataacgctgtctttcaatagcttgatttttttaaactcagtatcaagtttttgaggtgtatatgttgatgcgtgtacatgtagtttattcagtttcactgctgtatggcacttcattttatgcatagataaaatgtatgtgtcccactattgatggatattttgagttgttttctttttgctattataaataatgctgcagtgtttatttttacatgagtgtatgtgcaggtgttttgggaaaaaccgtagaagtgaaattgctggttactagatattggtaaattcttttcctaaatggatatgcccatgtatactttatcagcattatgtgggcatttctagcatcctcacccatacttgggattgtcagattttaaaatagttactaatttgaggcatgtgaaatgctatctcattttaatttacagttgcttgattattctgaatcgtaggtaaaaggataggaaatttattattttctgtatgttttaaatatctcaaaaataaatgtttttaaaggaaaggcacactatcgtacaacatttatgttgaaaaggaccatgaagatcatttcatccaaccttcttactttacagtgcagccaaagaaagttaccagaataagagtaaaatataaaatcctgcccattgtagtattctctggtagtatgagccttaatttttgatgtaaaaatcatgtctttttctttatgattgtgctttttgtttaagaaatcctctttttatattgtctgctaatagttgaggattttttgttactctttgttatttgcatttaggttcatctgaaaggagttaggattttttattttaaatatgaaaagctagttgttccagcattaagtattgaatttttaaaattttgtattgaggttaaatatacatacataatttaccatcttttttaagtgtacagttcatttttaatgattttttaagtgtacagttttttaagtgtacagttcagcaataataaatacagttatgttcttctgcctttgtcctctcactccccacttcggctgctagtaaccaccagtctatgcttatcttcttgagatatacttttttagcccatgtatgagtgagaacatgtggtatttgtctttctgtgtttggcttatttcacttaacataatggcttcttgttccatccgtgttcctgcaaattacagggttttattcttatttttatagctgagtagtattccactgtgtgtataaactacattttaaagtctattcgtcctaattattgaattctccccaccccacccacctttttttttttttttttttttccaggagacagggtctccctctcttccccaggctggagtgcagtgccatgatcatagctccctgcatccttgaaccccctggcctcaagcgatagtcttgcctcagcctcccaagtagctgggactgcaggcaggcacctccaggccctgctaagttttgtgggtttttttttttttttttttttttttttttgtagagatggggtcttcctatgttgcccactttggtttgttagttttagtagtttataattcctttgtattattgtgaacaaataacagttattttgaaatagaagagtgctttctatttaaaattttgctttgatagggttctgtctactttctgagccttaccttcctgtgcattcccctttggtcagtaccatcttaccacacaggctgcttttagtttcttgagttatccatcttccttctatcttatagggctcaacctaaatattactcagggaagccttccttgagagtctttctttttgcactcattggtttggggcttctttatattatactgttaattgaattctgagtcgtgtttatctcaactgagattaggtaatttattttgagaacagtaaatgtttatcatctgtcattctttttttcatgcccacattcagttatttgtaagtgctgaatgtataagtgttcatctacagataaggatcagttcttttttccccaactagaaatgttactccagttgataataacagctcaaacggaaatataaggcagaggtgagagagtcacttgaggccacgaattggagaccagcctgggcaacaaagtgagaccttatccctatgaaaaataaaattagcccagcttgggaggctgaggtggggggattgcttgaaccctggagttccaggctgcagtgagttgttatcacaccactgcactccagccgcggtgacagaccctgtcccttaaaaaaaaaaaaattataaccagccacattgaaatattttgtaagacattaatagaagactaaatgttctcatatgtttactgtttgtgttaagtacgtatggtttttagaacaacagttttctatcaagtgtggtctggttcacttagaattagatggggtagattttttgaaaagcgttttgaagttaaattagaagctaatggttttttgtcactaaatcaaattttgttttatgcgtttaagtgctacatttatttgataggcaggtgaatgtaacagattaaacttgaaaataatgtagctatgattccttcaaggaaaaacccacctacctttagttcttttagtatattgcattataagtcttttgtgtgtgcatatatagcaggcataaattggcataattctgggtttaattttaggctaggcgctatggaagtttgaactctaattacagtgtaaaaataacccagaggaaaatttcagaataataaatcattgggactatatggtacagatgtccctgttttcagattgtagaattgttgaccagtaggaatgctttatgattaaaagccaggaaattaaagtaattctgatgatttggtatttctaaagattttcatagatgacagttgagaactactctcagatgagattcttccattgctggtaagtcatgtaataaaacacttaagtaaatattttaatgaggaatgataacattttaatattggcacattgtgagtctaccttctgtagttagtaggtaaataagaaataaacataccttatttaaaaaaaaaatttcaaagaacccaagggaggggagagccaaggtgcacattagaaggagattacagtactcttccagtgcacagtggatgtgttgtgattccagagttctatgtatgtatgactgtgtagcccagatttaccagcatgggctcagttttaaatgttaggttaggctcataaatcatgaaaagttcctaggaattctaacatttttacatttccagaagagagcctcttgtattttgtggtagttgccccaccatccctcaaatattggtgtgtagaatctatttttgaggatgaggaaatacagaaaagaaaaataaaaagctatttttttttaagtataagaagaaatgaaaggtttctcttcgcttcatagccaattctaaaacttaacagttgttaagtgtgtttaactgtagagggaaaaaaatgcctggaaggaaattaccaatcaaatataaaatgtaagatagctgtaaaagtactgatatacatacagcttttttccttttggggaggcagtatttaaaaaaaatcctaccaaacatattctctaactttcaaaactgttaatagctttattgagataattcacatactataaaattcacccttttaaagtttttagtatattcacagttctgcagccatcaccactattgaattttagaacattttcatcatccccaaaataaatcctaacctgttagcagccattccccattctttcctggcctctggaaaccactaatctgctttgtctctatgaatttatttattctggatatttcatataaatgggaatcatacagtatgtgtccttttgtgtgtgggttcttttacttaccatggtattttcaaggtatgttcattgacatgtatgtctgttttttttgggtaacacacactcttgattactgtagctttgtagtaagtcttgaaaccaggaaatgtgagtattctaacttattctttttcaaaattgttttgggtctctgggtttctcaaatttccatagaattttagggttagcttgcaaaaaaatgcaactgggattttaataggacttggatttgtgttgaatctgtaggtctatttgggaagtattgctaccttaatactgtcttctcattcatgagcatgggatatctttccatttattaaggtgttctttaatttctttcatgttttgtagttttcagtatacaggtcttgtacttattactttaaaaatttatttctaagaattttatgttttgatggtattgcaaattgaattttttaaaatttcatttcaggtttttaattccttgtgcatagatttttgtgtactaaaacttgtgtttcatataatttttttttcctcttaactgtgttataggaatctttcaaatggttggctacatacacatccatctgattcacttagtaaacatttcttgaacacctactgtgtagtgggcctttttttctaggtcctggtagagacagcagtgtataaaacccactcagtcctttgctttcatggcacttaaatcctaaaaagagatcataaagataggtaaaatatatgttacatagtgctaaggagaagaaacaaataagggaagtgtttgcaggtgaaaaggatgatgggaaattttagatagggtaggtagagaaaacttcactgaaatggtaacttgggtgaagaactgagggagatgagagagctagccatgtggatatttgggggaagagcatttcaggcagagtgtagtgaatagggaaaccccaaagtgagagtgcctgatgtgtttgaagaactcgaggtgtggccagtgtagctttagaaaagtaattgatgggaaatagagagaatggagggtacagatattttgatcataataaggtgtttgatttttacctataagtgagatgggaagctattggaagtctttgagcagagtagtgaaaaagtatgacttatgtttagcaaggtcactctggttgctgtgttaatcatagactgaaaaaggggacaagggcagaaacagaccaattggtagaccattagtacagattaagacgtgactgaaatggacagagtggtcacagtgagggtggtgagaagtggttgaattcttgatatatgttgaaatagagtccataggatttggtagtagaccagatgaaagtgggaaataaagggaggagtaaaacatgatgccaaagttttttgaccagagcagctgagagaatggagttggataattcttataaattattgcattaaatctgtgcatcatatcacatgcccacttaactacaggtaattttaccatataagcttgtggggggaaaagaggaaaaacagaaaaaaggatggaaaagcatgttttaaaatataataaattaggccttaatgaaaaattgtccttgagaaacctgagatggaatactctaaatctgatgtgttctctcaatctttagaactgaactaggaattaactctgagagttcatgatgttatgagaccctttgcctgttttggaaattcggttgttttcaatatttgcttttgcaatgatggtacctgttattttttctgtaaggtagattcctacaaataagatgtcaggccattagatcatgtcaatctaaatatttgataggttttgccaattaccttttaaaaaataattttagcaagtttcattccttaaaatatattagggactgctcatttaccttgttttgattcatgtatatataaaatctgtttaagtctttataaataacctgggaaattgcctggttttttggtccatttctattgtggtgtttgttttttaaatttgtaagcattctttatatatcatttaattctttattataatttgcaaatattatctctacctacctttaattttatagtatctagtcatgtgaaattttaaagtttttatgtaggcaaatctgtccatcttttatggtttctgggtttcagcatgctaacaaagttgatataaatatgatctcatatatatattacaaaaactttttagagataggatctcactctgtcacccgggctggagcaaccatagctccctgcaacctcaaactcctgggctcaagtgatcctcctgcctcagcttcccaagtagctaagattatagacatgtgccactatagctagttggtttttttttggttggttggtttttttttttttttttggtagagaacgtatctcagtgtgttgcccagactggtctcaaacttctggcctcaagctatcctcccacctcagcctcccaaagtgctgggattacaggcatgagctactatacctggccaatctcttgtattttcttctgatacttttgtgattttactttatagactttaatttagaaagttagatatgagcattcagcatatttttggatatggtatgatatggtttagatctggattgcatttgtcatggtttgggaattatatctaccttttattttcttccacttgggtagctgattgtcttgtaaggcatcctttccccactgataatgccacctttttctatattaagttctcacaaactttgaaaaaaatcaagtttattgatgtataattgatacacaatgaaatgcacccattttaactatatagttttattgattttgataaatatatacactatcactgctactacaatcaagctttagaacaattgaattacctccaaaaagttccttcctgtctgtagtcatttctccctcttggccccaggcaaccactgatctgtttattagttttcctactctagaattgcatatccatggaatcaagtaacatgtactcttccatgcctggtttctttcacttggcatgtttttgagattcatccaatttgtgtttgtcacagatttttgtttgtttcgtttttttaaatacaatatgactataccacagttcattcattttctggtgaacatttaaattgttttcagttttaggctgttgcgaataaaggtactgttttgtgtgcatgtttttgtgtgaacatatgttttcatttttctagggtaaataccttaaattggaattactgggtcacatggtaagtttatgtttaaatgtataaggaactgccaaactattttccagatgattatactactttacattcccatcatcagtgtatgagagttccagttctccaaatgtcagcatttgatgttctcagtctttaattgcacacgttctgagaggtgtgtagtggtatcccattgcagtgtttttttttaagtggtactaaaatacacaacatcaaatataccattttaactatttttaagtgtacagttcagtgacataaagtacattcacattattctgcagccatcaccactatccatctctgaaactttttcatcttctcagtctgaaaccctatccattaaacagtaactcttcattgcctactctccctatctgctggtaatcactgttctacttcatatgtgaatttgactcttccaggtacttcatataagtggaatcatacgatttttgtccttttgtgtctggcacatttcatttaataataataatgtccttgcgttaggccattcttgcgttgccttaaatgaatatctgagactgggtaatttaaaaagaaaagaagtttatttggcccctggtgctgcaggctgtacaagcatggcgccaccatctgctcagcttctggggagccctcatggtgagtttactcatggtggaaggcaaagggggagcaggcgtgtcatatggcgagagcaggagcaagagagagggtggggaagtggcacaccctttttaaacgaccacatctgcgaactcactctgtatcccaaggagagcaccaagctatgagggattgctcccatgacccagttacctcccaccaggccccacccccaacattggggattatattttaacatgagatttgggcaggacaaatattcaaaccgtatcagtcatcaaagttcattcatgttgtagcatgtatccaaatttgattctttaaggttgagtaatatttcattgtgtgcatatatcactttttgttttatttatttatttgtcagtggacatttggactctttgtaacttttaactatgtgaatgatgctgctatgaacattggtatataagtatctgtttgagtcccttcttttaattcttttggttatgtacttaggagtggaattgctgggtcatgtggtaattgtatgtttaatttttttagagactgccatactgttttccacagtgactgcaccattttacattcccaccagcagtgaataagggttccaatttctctgcatcttttctaacacttggtaatttctgttttttatttaaaataattgccattctaatgggtgtaaaaagtcattatggtcttaatttacattttcttcatgactgctgttgagaagttttcttttgtgtgtctgttcaaatattttcacattcttttcagaacatatgttctttgtcagatagataaatgtatttcttctgtatccttactgattttctgtccacttactaattaccgagagaggaatgttgaaatcttcaactataattttgagtttatcttccttctgctctgttcattttttcttcatatgctttgaagcaaagtctttaaagttgtgtccttaggtgtgttcacatttaggactgttagatctccttgattaattgatgtctttatcattatgaaatgtctctgtttatcgctggtaatgttccttatctaaagtctactttgatattagtgtatccattcctttcttatgattaatttttgcacattatatcattttgctgtgtttttattttcagcttattggtcatttaatgtctttcttttagatagcatatagttgcatcttgctttcagattgactttttacgatcgttgctttttgattaagtccatttacatttattgcagttggcaatataattgtgtttaagacactatttgttttctatttgtctaatcttttcttccttttctgccttcttttcggttaatggagcatttttggaattttgtattgtctccattattagcttgtccctctgttttttttccccccagtgatacttctaggatttacaatatgcacctttaacttacctcaatctaccttcaaaaatattattcctcttaatgtataatgtaagaattttggaatagtatacatccatttactctccctcattctttttggtattatgatcttaacattttacttctatatgtgttatagattccacagcagcgtttgaaactatttctttcaaaggccagttgtcttacgaagaaacttaaaaactaagaataacattcctttatatttaccttcatatttaccatttttatttatttttctttgtggagattcctttttgtagatccaagtttgttgctggtgttattttccttttacttgaaaaaatttcttaaacatttctaaagtataggtctactggctacaaaatctttcagcttttgtttgtatggaaatgtctttatttcactcttcattttatcgtacaatttttcaaaccacacagactttaaaataattgtagaatataatttcacaacattttgttctatttgttattgtcttctatcttgtccatctatccatcctgtcttcttctagtgtctttttttatgcttttcaaagtaagttgcagttgttagtataccacacccttaacttgagcatgtatgttaactaaaacttagtagtttagtatttttaactagaatttactatgctgttccagttatttattgctgtgtaatacattgccccaaacttagtgccttaaatatcagcaactatttattttgctcatgaatctctcatttggtcagggattggcaaggagagcttgtctttgacaatacattgtaacaactgtttacatagcattacattgtatttggtattataagtaatctagagatggtttaacatatttgaagatgcatgtaggttatatgcaaataccatgccattttatataagggattcgaagcatccttggattttgggatccatgggagtcctggaaccagtcctctgtagatagttgaggtatgactgtagtctttggattgaaagactcactaatttcactcagattcaaggagaagggccatagactccaccacctgatgaaaaaatgacagtgttacattgttaagagcatgtggaatggcttctattgtgaccatctttggaaaatacagttgaccacatataccatttcatgagctgtgacaaatgtatacacctttgccagaaagttctatcagggtatagaacctacacctcttcctagttattccttccccccacaccacccctagaacctaacattgttcagattgttttcatcttagtttagcttgcgcagaactttatgtaagtagagtcatacaatacttatatgttgtaaaaagtttctttttgctcaacataatgtttttgagattcatccatattgttgaatgtttcggtggtttgtgacttcatctgttaagggacacctgggctgttttcagttccaggctgttttcagttcccagctattataaaaaggtacaatgaacatttgtgtaaaaaaagaagtctctgtgtggacatatatgtttcttttttcttggttagttgatgtgtttttctttcagcatttgtttttgatgagaagtctggttatacagtcatgtgccgcatgctgacatttcagtcaacgagatcatagttgacaatagtcatttaagattataccaccatattttcactgtaccttttctaggtttagatgtataaatacttacactttgttacagttgcttacagtattcattcagtatagtaacatgctgtacagctttataacctaggagcacccgggctataccatgtatcctagttctgtagtaagctataccatctaatctagatttgtgtaagtacgttctatgatatttgcacaatgattaccatgctgagagttgttggggttttgttttttttttctttttgaatctgtacatttatggttttccttaaatttggaagattgttgccattgtttcttctatatatatattttttaccacctttactcctctttcatcatttcctctttttctgggactccagttacacatatgttagactgtttggtattatccacaggtcattaacatcatattcattatttttcagtctttttatttccctgtgcttcagtttgctttgtcttctattttactgttttttctcctcccttgttaaataatttcagatatttcgctttatatttcaagaaattccatttgattcattttattcatgtatttttttgaattcttgagcatatttgtaatagctgtttgaaaatcaggttacttattgatttcttgaattttttcactctgaatttgttggttggttttttctcttggtcatgggttgtattttcctagtatttattttattttattttttgttttttacatatttaatgattttttaagattggatgctggacattgtaatattttgttgttgggtgtctagattttgttttcttttagagtgttttgttttgtagccacctaaataacttgctggtcagttttatcccttcagggctacattggagtttgtctagagaaggctttgctttaatggtagtagctcctacctaaggcatgatccttctgagtctttactaaatgctcccagtgtcaccgtgttctcttcactcaggttagagagaattttaggagtctcccagtcctttataagtactgggaatatttcagcttactgcccctctttcactagcttcatggagtcacttaccttaatcgtgtacagttagtactcagcagtggactctcaaatggcagatttctgaagccatttctctgccttctcagacaagcacttgtctggcacttgtcatcaattttacccacttcagctttctcagctctgatctcttgattctgaactcagtaaaactgctgtcttctcactggatttcccctccattgactgcaggttggaaattacctccaggcagacatccaagcagtggatggctcacctcctttgtttttgtcctttcatgcattatagtcctctgctgcctgttatccaaggtctgaaaattctcgtttgagaaggagcaactgtcagatactttcggatctttctctgaaattagctttctgttgtgcttgttgtgcttacctctttgtctaatgctaataccatatgaggtttttttttttttttttagaatgttttaagctatacacttctaagtgtatagcttgttgcactttcacacactgagcacccgtttagctagcattcagatcaaaaaacagcagcagctcctgcgtagccccttgtgctctgtgtcactaccccttttcttccatgtgtaaccactgtcctgacttctcatagcatagattagatttgcctgttttcatcctttaactagaatcaagcacatttagttgtgtctgacttcttttaatgtatttgtgagatttattcacattgttggttgtagtaattgtttatgatagtcgctgtatattccattttaagaatggaagtgatattccattttaagaatatgccatagtttaatctgctgttacggacatttaatcatttttggtttggaactgttaagaatattgctgctgctctaaacatttcagtgattgtcttcttgtgaatatgtttacttctgtttggtatacttaagagtgaaatttttaagtcataaggtatgcatatatttagtgtatactcagttttttaaaggcatgccgattttaattattccatttaagttaatatgttttaatatctggtagagaaaggaacattattagaaacaattgttttggttattcttacatatttagtctttgaaaaaacgtttcttaaattggcatttacttatatttgtgttaatttgggaagaaatggtatctttgttcatctatgagtcacatttggaactagctcaaaggccatgggtcctgattccttttttttttttttttttttcttgtagaggggaggtatggtgtcaagaaaacatagtcaccattattacgaaaagtaaaatatggaagagatgatccctaccatcaatcagcttacaactagaggcactgacaaatgtatacagatagctgtaatgtaaggtataacataataaatataaggagaaattaataaattattttatggtattaagaatgtataataagacatgaaggagatggtgattatgtataagagtttagataaccctgtgagatacagtgtttagaatgaggccagtttttaacatggcatgataggtgggtgggggatagaggttagtaatggatagaggaccatttccgagtgaagtctcctcagaagcaaaagcattgaagtcagaaacacaaatatccagtacattatagccaatagtcaaatgatgggactagatctggtaactggtgatgatgtcatatagtgggcagtagtgctgggatggctggggtcagggccacatggcaggggcctcaaataaaatgtgaaggagttagaaatttattctgttggcatgagaaagtgttaaagcttttgaatatagaatgatatgtgtaactttgagtttttaggaagataattctagtggcaaagttgaggataaaggcaaaagggaaaccagatgaaataatggggcactgtagtaggacagtgttggtaagtttgaggaaaaaaggagtaagagatatttttaaggaaattcatagggtttgagtataaattagaaggcaagtacaagggaataagcgtggtctttagaatcagacaaattagggtttgaatcttaaccttgcatttactaaaggactgaaagctagttccctaagagaaaaattttctcttttgtaagatgcttattctataaacatttgcaagcactggaagtataaaagcaaatgatacacatgttctcttgaagtctggtctagtctgtaagaagaggctgcactggcaggttttgaccaaattgtgtagaatctcatctgacgtgattgggagctttggctttattctggaagcaactaaaagcaatcaaaaaagactggggaataatgtgagaatgtagaaatgtaggggaatttctaaggatgaattggtagcaattggtaaacaatttgatatactgggaaagagagagactctttagaatatgactgagaatcttccaatttgagcagctggactgatagtgctaccatcattacctcacagggtttttcttagtgtgtcttgtaaatcttgcttgtccctcataaagaatggttttccttttcttcagactaaggactttttattacagtacacaacttaacaccccctgtatctctccatcacaacacttaactgtgcattgttattgcataattaattgtggtttttatttgtgcccatttccttcaccacatgagggcaagaaattatgtctagtttttctacctctgcatcttcatccacctagtaggcactcaaaatctagtagacagtttttgaattaatgattatgaagaatttgaaggctgaacaagtatcaacctacacagtggttagggcaaataaaaatgagggggagaaagtaatgaatggcaccaatttttttagtccttaaccaggacagtgagattaggcagagtgagttctttgggaaaataattgagtttgatattagatacgttgaatgtagatgttaatgagacatccaaatggatgtgtaccgttggtaatatgtagttgcaggcataccatgccagacataaggacttaaagatacagagttaggggtttgtaagcatagaggtgctatgggaatggatgacattgcgcagaaaattggtttaggttaagaaaagtggctattgacagaaacttggagagaggccatgtatgaggtaggaagatgaactagcagaagaccttattgcctttagagagatggaagaaaatgagtggatacaacattagggaagccagaggaggtgaggagtcattagcagtcttaaaagctacaaaaattaagtaggattaaggggccaaagcactgggaatatacagaaatgatggaaactttacaagaaaaatttcagtagatagaaaaatagcagctgagctagtggttttcacgtctttttggcagtaaaaggaaagaagataaagaaatggtactctgaggagctaatggagttgagggaattatgttgcaagtattatttgaaagcagtatttaaaactttttaagtcttaactgcagaatggactggaataaggagaaactaaagcaggaggacttaggaaaattgttgtagtagtcctttaattgtgaaatgtgtaaacggacaaaacttagacagttttaataagtagcattatccataaatataagacaccataaacatgatgcaaaggagaacagaagtgttgggtgttataataaaaagtgatagaaaaaaacagtttgtgaaattaagttttgaaacagctttagaaggaggtgaaggaaaaatagaaatgaataaaatgaaaattttagggaggtagatatagatcaacataggcatttattattagactatacttatttataagattattagactgagccctctgttgaagagataaagtaagagaactatgtctggtattaggattcttatggttaaattggcaagtgagtgtgcctaatatttgtagtgcttacagtttttgttattctgtatttttatagatttggtatatttcctccatgattatgtgttcctaactcataatttggaaggcagggcttcttaaaatgagatctgtgtgtcatgtgaagtatatgttaaaatgcaaattcatttctgcgttcttgggttggtctgaaaaaaattaaaaaaaaaattcatttacccctacttcatgcactgaatgaaaatctttgcgagtagagcccaagtagttgcatttttagatttccccaggtaattctattatagactgaagtttgaaagtcagtctctaaaaccttaaaagttggttaattttatttcaaaatgttttatatgcagtgtattcactttctaccatcaacctctaggacactggataggtttcttaacctttgagatttgctttctttatatgtaatgcagtacatgaaaggactttatttttgttccattgaggaatgttctgattgtatacaaacaagttaagaatttacagtgataatttaggggcttgctttaagcttcaggatttttttttaagagttaagttttgatatatattaagtggttgatttaataaattataattatcgtcgtatattgaagtcctgttttgtgccaggtaggcattatactataactttttaacgcattttctctgctacaataacctgacattggagactcaagggtcagagggtcggcccaaggctgctactctagaaagtggtagatgcccagatttgtacctaacatagccgatgcttagcatatagaatttaattaaaaacaaaattgctataggtatttgaaaggattagagggatatagtcaaatagttttcatatgtgtttagcccttttggagggaggatagagtaaataaatagaaggcactaagctttatggatgaatatgggaaatatggctttgcctgctgaaagcactcaggccacagggcctgcctacctatgctttcctcatcccggcaacagcagtaatttgtttcttgatacgtttttggatgttcataattatagaaaataaatttgcctttatgatgaaatttagtacctttttttttgaaagttcatccagttgtttatgtaaaaagaattgagtgaggtgttttatattttaggttaaaaatctgtaagagcctgattttagaattcaccagctcctcagaagtttggcgaaatatggtatgtttttgttttattttttggaattcgtattgcatgtgtatcttaatgtcataataatgacagatgtgttcagcaaatttgggcccctgccatttttaaagcattgtgtcaggtgctcactaactacacttccaagactgtatgagggacccaggtagggtgctgaaaaaatttacaagagattagtgtgctatgagaggtaaaataatatgcataaaaagattgagagggcaggtttggattttgggctatgagtattaataatagctttcatttgttgttgttgttgctgctgctgctgctgctgttgtttttgagacagagtcttgctctgttgcccaggctggagtgcagtggcaccttcttgactcactgcaacgtccatctcccaggttcaagtgattctcatgccttggcctcccaggtagctgggattacaggcgtgtgccaccacacctggctaagttttgtatttttagtagagacggggtttcaccgtgttggccaggctagtctcgaactcctggcctcaagtgatccacccgccttggcctcccaaagtgctgggattacaggcgttagccaccacgcccagccatttgtgagcacattatgtcaggcactgttctgagatacttagatgttagcttgtttatccatgacagctctatggaataggtactattatcctagttctacctataaggaaactgagactcggagaggttaagtaacttgcccaagatttctcagctagtgaatgaccaaacagagacataagtccagcctggccttggagccttttgagcaccggatctcataaaagaggggactggaagagaggacttgactctagttttcaaaatacatatagctctttaattacattgaggtcaattagtcaattaaaagatattttaactttattatttttgtgtttacaagatggaaagttagacttgtttgaatcttctaattccacataccattagtctcttgagaacccaaggggaagctgtatcatgaccacattgtttattttagggaaggtggtgtttcccatatgacctcagcaatgtctaagttcttattaggcaatgtatagttaggataggagtatctgggagattgcgttatttcttacagatactataaatcccatttattggaatcccctgcaattatttttatatattcaggccaatcctcacctaatctggattttgaagccctgcgttcatagctgcataggtatgggctcaaacattcatgttttaaccgttggtattcgcagataccttgctgttttatattgggttctgaatccacactggtaaccaccttttacgcttgactattgttgctttgaggatgttaattatgaaaggtttcttcctcctaatttcctcatctttccgtagttgatgcctcagatttggcctggataggggaatcgtgaggggaaagaactagttgcacaaaatgatcttttgatactgggatatttcagatgtatggtatctttgccagaactacagtgtcagtaaagaggcctgctaaatttgaactgtgacaatcagaaaagttcagctaaggccatgtaaggggttaaaaagatatttggttgagggaggaggatatgctttcatcttttgccatactttttcatgaaattaaatcttagtagatttatggccaagaaagagtagaatatatttttatgcagtacttaaggggttttgactgatgttttttattattattatactttaagttttagggtacatgtgcacaatgtgcaggttagttacatatgtatacatgtgccatgctggtgtgctgcacccattaactcgtcatttagcattaggtatatttcctaatgctatccctccccttccccccaccccacaacagtccccagagtgtgatgttccccttcctgtgtccatgtgttctcattgttcagttcccacctgtgagtgagaacatgcggtgactgatgttaaatgactttacgtacatacagaattagtgggactagactttgtgtttatgtgtgtgtgtttatgtgtatgtatataactattccattaagcagttgccctccttggtgactgattgctctatcagcttaggaatcttttgactgaatttgtccgtatttgaaagatctcaatctgtgttctgaatctttactcatttacatatacttaaatcttgaaacccagtatagcaaaactaagccaaaacaaacaaaaaaatccatcccttgataggaagtcagtatatctgggttttagtcagtccttcaacactagttccaaaatcttgggcaagtcagttaatcactcggaggctgcttaattttttttttttttaattcttagtatattatctgtcttgattaggtaaagccaaagttgttataagactcaaggtactattgaccaaaatgcttcagaaactataacattacataaaagtacaaggaattattacattttctcaaatgaagagatcatttaagaaaaacaaaatgctggaaaatagtccttaaaaacttttctataataattactcttctgatgaattttacattgacacctaatttgaagctttgaatattattttttgaacaatgaattgggtttatatattaaagtgttctaaccaaaggtttgtttaatttattagagttattaagcctacgctcagatcaaggtagcagctagactggtgtgacaacctgtttttaatcagtgactcaaagctgtgatcaccctgatgtcaccgaatggccacagcttgtaaaaggtaattttgaattattttacagcctttaaaaggctgtcattgtaaagtgaaatacatactgtaaaaatgaagacaatgtatagttggcaggaatactgctaagaatagtgggcctgagagttgacctacttcatttaatctccttaaaatattttagtgtctttttttctcattaaaaatatcagtagccactatcaaagacctatctgtatgtataaacaggaaagtatttctcaaaaaaacttcaaggttttaaacattttactataaacattatagaaaacattaaaaatttcttaatatgcattttaaagtatgccttttatgtggtgaacgttttaactaaacatttctctagaagtttttataacattaataaaactagtatacttttctctcctagagagttacagtggaggtaaaaggagtggcttgcaggatggagaagctgcaccagtgttattggaagtgagccaccatttgaatttgctagctcatgctgcagtattcagattagtgggtgttttgtgatcatattttctgcgattcaaatcaagacctaaaattgattctcattctgagatttacattttattatccaatgttatttggttattgtttcagttttaaaatttctgacttgttattctgacacactttaggataacctaagtcaatagtttaatacaaaaatttccctttggttatatgttttgaattaggttatatgttctgcatttacaagcacatacaggattcttacttccagcaacttggcagtaaaagaataagtagactctttaggagccaaagtcaagcttgggaactgttgctaggtggtatatatttcatagtttatgtttgtttccaagacaaggtctcactccatcgcccaggctggagtgcagtggcacgatcacagttcactgcaactttgaccttctgggctcaagtgaccctcccacctcagcctcccaagttgctgggactaaaggcacccaccaccacacccggctaagagacgaggtttcatcatgttgcccaggttgaccttgaactcctgagctcaagtggtccttatgtcttgacctcccaaagtgctgagattacagacatgaactaccacacctggcatatgtcatagttttgagagtttgaattctaacctcgggactttggtaacttatttataatattctagaaatatactgttattaggatgagtagaaattcattcagacagaaactattataaattactgcaagaaaaatgtctgctagttctgcatatattcatttttctcttgattaaaaaacaatttccaatttgagtagaacaactttgctatgtttaatagacccaggacagatttattttaaggtaataatctttcaatccttcttcttctatactggattggtttaaattacttagcttgtcttatcaatggtttttaatagcctactttaatatatgtaaaaagtagtaattaatatgttacagtttggtggcaaacattttgatgccaaagttcacatattctcttgcttagggaacagaaattgggaagatagatgtagttatcatttgataatgtatttaaactctatcccatttcaggatctcaaaactttgtaacagttacatattgtacttctaagacttagatttgtttttcttcttgtgtcttacctttttgcagtaatatttttattttcctatcatcatgtcctcattttttccctctcttctctttccctgttaattttgaaagttttgctgcctacgtgtttgaaaacttctaatctgcctctcttccctcagtgccagcaggtttattttttgttttgcaagccagctctgcctccttacagtatgacatctgatgctggagggtcgcactttcaaaaatgagtcagctggtacatggggttatcatcaatttttagctcttctgtctgggagatacaagtttggaagcaatcttggggtacttacccacaaggctggtggagaccaggtgtgtcacataggtgatttgcttgctccctgggggagagggtggagtgaaatttttgcatttgtgtcacagccaagtcactgccacctccagcatgccccagtttttagttgttatgtaattttgtgcaaaattgaaaatttaaatacattgcaaagaagatctaaaataaatatttgagctgctggagtcttttttttttttttttttccttttccattcttgtccttggaatctgaatgaattgcagtgagggtaattttgagagtctgataaagaagtgaggggttgttttttgtttttgtttttgtttttagctaagaaatttagaaaacaggtttgtgtgtgtgcgtgtgtgtgtgtgtgtgtgtgtgtgtgactgattttaagattcttgttagagttgcttaaagttggaagcctaaagtcagtgagaagttcacaaatcaggactttgtaatgccaatttgaaaatttagcttttgacctcaaaaaacattttttatctagtttgggaatttctaagtgttagaaatcaatattatattgactcattcattgttgctgatgctgtttataaaagtgaatagatagggaaatactgattcatatctcgtgaaatgaaaatgaaaggctttttagtgacttagaattttaaatatttctacatgagagagcagtagtatatttagaaataacaaagtaactggcaactgtttaaaactgaagttaattcacagctatccagtgcaaaacttcacctcaggtgatacacttttgacaggtaatacatacagtaagtgtatttttagggaaacagtttcattgttgaaccaagataatcatcattagaatgttgtatctgatttaagtgtctttaaacttaccaaggtattagattttagtttgaattgtctggagtagcggtagcggttggcacatttgttcttaaagggccagaaaataaatattttaggctttatgggccatgtggtttctgccacaagtcctcagctctgttcttttagtgtgaaagcagccatagatgatacctaaatgaatgagtatggctgcatcccaataaaacttcatttacaaaactacatggctggcctaagctttagtctgtctgcctagggagtagtttactgagccactaatctaaagtttaatactgtgagtgaataccagtgagtacctttgttaatgtggataaccaatacttggctataggaagttttttagttgtgtgttttattacacgtatttgactttgtgaataattatggcttataatggcttgtctgttggtatctatgtatagcgtttacagtttcctttaaaaaacatgcattgagttttttaatagtccaacccttaaaataaatgtgttgtatggccacctgatctgaccactttctttcatgttgacatctttaattttaaaactgttttatttagtgcttaaatcttgtttacaaaattgtcttcctaagtaatatgtctacctttttttttggaatatggaatattttgctaactgtttctcaattgcattttacagatcaggagaacctcagtctgacgacattgaagctagccgaatgtaagtgtaacttggttgagactgtggttcttattttgagttgccctagactgctttaaattacgtcacattatttggaaataatttctggttaaaagaaaggaatcatttagcagtaaatgggagataggaacatacctactttttttcctatcagataactctaaacctcggtaacagtttactaggtttctactactagatagataaatgcacacgcctaaattcttagtctttttgcttccctggtagcagttgtagggaaatagggaggttgaggaaagagttgagtttaacagtctcaacgcctaccatatttaaggcatcaagtactatgttatagatacagagatgcgtaataattagttttcaccctacagaaatttatattatactcaagagtgaaagatgcagaagcaaataatttcagtcactgaggtagaatggtatccaaaatacaatagtaacatgaaggagtactggagtacccaggtatgcaataggaatctagtgtagatggcagggaagtaagagtggccaggaaatgctaagttcagtcttgaaatgtgactgggaatcaggcagctagaagcatgagcggcttattccaggcagaagtatgagccaaagttagaagcagcatagggagtaggggacaataggcagttgaggacttttagatcataaactagctgagaggtaggaaaatgaagaagataagatgtgatagaaggtattagggagtcagcaaagaatttgctcagtaggtagatagtaagtttgtcaaacgtgtatttttaataaccttgcaagagagaaaggattgaagagaaacgtgtggtggtaaggtagttcagtcagtgagagccttgacaatgacagtggtataataggaattcaaaataaatttttctggatttaagacaaatatttaggacatgaagtaagtaagactttagtgatttattgtgaagactaaagatgtttcagataatagaggtagtaattatcaaagcaaagtttttcgaggtattaagggttggaatgaaaaatacaggtgtatctctcatacaggtaatataaaaaaagaaaaatgcagatatagtgattgaccttgaataagaggaaagatgcccatctaatgaaattagaacaaggaagtaaagatggatgtgtgatattaattgtaattgtgggtgagggtggaaaaatcaagatttttttactgaaaatattggaaccttatttaaatgccggtatatattgtgaatctgcaagaaacgactataaaatgtatttctcaaatttatgtgacccaaccatgtgacttgtcttttaagctttaaaaaattgtagtaaaatacacataatgtaaaattttccatttcaccatttttaagtatttggctcaatggtattaagtatattaatattgttgcacagtcacgatcagaactctctgttttgcagaactgaaactctgtacccattaaacaataattcctcatttccttatcttcacagcctctgacaaccattattctactttgtgtctaattttgactgctctaagtaccccctataagtgcaatcatacagtttttgcccttttatgattggcttattttacttcgcagtgtcatcaagtttcatccatctttagcatgtttcaaaatttgcatcctttttcaggctgaataatgttttattgtatgtatataccacattttgcttatccatttacctgttgatgagcgctcaggttgcttccatgttgtagctattacagataatgttgctatgaacaggagtgtacaaatatctttttgagaccctgctttgaattgttttcccagaagtggaattgttggatcatatggtaattttatttttaaaattttgagaaactgccatactcttccagagcaactgtacctatttgcgtttctaccactagtgcacaaggggtccagtttctctacatccttgccatcacatattgtgtgagagtgtgtgtgtgtgtgtacttcaatagtagtcattgtagtggatataaggtagtatgttactgtaggttagtgaccacgaaactttttatgaaacattttttaataatattttgtggaatacaaggtttgtttagaggttttgagaagactgaaaacttaggaagctactgaggggaatgggtgaagaagtggatcagaagttgagagtcttgactggctggctacctgaaatcagaaaccgtatcagagtaggagaatctcattccactgagtgactagttaagattaaagactttatcacatttgaaatttaaagacttttctccaatagccagaagattatgcatggtattttagggttggatattagcagagctgatggaacagaatcattagtggcatgtgcataagatgttaacattggagtatttgaatttatatgctgtggatgatggccatgattggaaaggttgggatgccagaccaaagtgttgagttgttttaagaaaagcctgaggtctagataacagcaagatggcagactagcactttgcagcactcatctcattgtagaaccatcaatttgaacaactgtctacacacaaaaatataagagctaagaaaccagacgagagattacctgaatgtggcacacagataagaaaagacacattgaaaagggtaagaaggacagttttacattacttgtgtcacacctccctcagtccctgagatcccagcatggagagagagactgttcacctgggggaaggaggggaagtgtacaccagacttagaccctaacattgagctcgccccagtaaaactcaatgctaggcaggcccccatggccccaaacttcaggccaatacccacaaaccaagcttggaggcccaccccagcaccaagctggatcccacagccctaggctctaagcctgtctagtgctagggtggtccctgcagccctgccctctagatcggcccctgtggcctcacatcactgcagaacaagggtccaaacccagtacttggccagccccttgtgatccaaattctaggccaacatccacctacccagccttcacactggtccttgcagatccaaggttcaggctcactctagtagaccaggatgccaggccagcagcacctgtgtaccaaggctccaggacctaccctgctgacccagactccaggccagccccggtagactcaggctgcataatctctggacaggctgactggtgaagggctttacccaataaagtcactctgcaaagactggaacaagtctcagcttcttcaaatgtgcaggtgccaacacatgactacagggatcaagaacagtcagggaaacgtgacaccagtcaaaggaacacaataaggcacctgaaccaaccataaagaaatggagatatatgaactgcctgacaaagaattcaaagtaattgtttaaggaagctcaatgaatttcaagaaaatgcagataaacaattcaacaaaatcaggaaaacagcaatcaaaatgagaaattttgagattgaaattattttttaacaaattctgaagctgaaaatgcaataaatggaatgaaaaatgcaaaagagcattaaaagcagaattgagcaagcagacaaaagaatctgaactcaaaagacaggttatttggctagactaaggaaaaaagagatgactcaagataaaaaaaataaagagttgtgttttttgatgataaaagcaacaagtctttagctagactaagaaaaaaagagatgactcaagttaaatcagaaatgaaagaggaaccattgcagctgataccagagaagtacaagaaataagaggatcataagagactgaacaattatatgccaacaaattgattaccatagaagaaatggataaattcctagacacatgcaacttgtccaagcttaatcatgaaatgaaaaatgtgaacagtccagtgacaaggattgtatcagtcataaaaatatctcccaccaaaggaagcccaagacttggtgactttactgctgaattctagcagacatttaaagaagaactagtacagattgttctcataattttatgagaaatttaagaagagggagtaatttcaaactcattttgggagatgagcattacctagataccaaagccagacaagaactctccaggaaaagaaaattacagacccgtattcttaatttagatgcagaaattctgaagaaaataataactaaattcaacagtgtattagaaggatcatttactgtgatcatatgggatttacctcaagggtacaaggattatccaacagacctgaatccataaaatgtgatatacaacattaggagaacaaaggccaaaaccatgttatcatttcaatagataattgagataattgagaaaaagcatttgacagaattcagtattctcttgtgctacaaaattttaaaaaattaagtatagaaggaatgtacctctataaaataaaggccatattgacaaacacactgctaacgttatactgaatgttgaaaagttaaaagcttttcttttgagatcaggaagaaaacgagaatgcccacttttgccatttctattcagcacagtaccggaagtccttgcaagagcaattaggcaagagaaagaaaaggcatcccagtaggaaaggaagacattgttgtccctgtttgaagatgacatgatcttgtatatagaaaaacctaaagactccaccagagaattgttagaactgataaattcagtaaagttgtaagatataaaatcaagatacaaaaatccgtagaatttctgtacattaatgacaaattatctaaaagaaaaatcaagaagacaattccatgtataataggtaccaaaaacaaaacatgcagtggctcccagtatcagtggttctgcatttgcaaattgaaccaacatttggatgaaaatatttgagaaaaaaatacaacaataaaaatactgttttcttatacaataaggaaactacagtatagcaactatttacatagcatttacgttgtattaggtactaagtaatgatttaaagtatacacgaggatgtgtgtaggttgtatgcaaatactataccattttatataatggacttgagcatccatggattttggtatctacaggagatcctggaaccaatatcctgcagataccgagggatgattgtacttagaaataactttaaccaaagagttgaaaactatgtaacattgattaaagaaattgaagatgatacaaataatggaaagttatcttgtgtttatggattggaagaattaatattgtaaaatgtttttattatccaaagcaatctgcagttttaatgcaatcctgatcaaaattccaatgttaaatttcacagaactagaaaacagtgctaaaatttatatggaaccacataagatcctaaatagccaaagctgtcatgagtgaaaagaacaaagctggagacatcacactatctgatttcaaaatatagttcaaagctacagtaattataacagcatgatagtcacatagaagtagacaggccaggcacagttgctcacacgtgtattcccacactctgggagactgaggcagaaggattacttgaaaccaggagttcgagagcagcctgggcaacatagtgagaccctgtctctaaaattaaaaaaaaaaaaaatttttaaagccaggcgcggtgctgtgtatctgtagtcctagctacccgagaggctgaagaaggaggattgcttgagctcaggagcttaaggtggcagtgaactgtgattgcatcactgcactccagcctggatgacagcgtgagaccctgtcttttaaaaacaaaagaaacaaaaaaacagacacatcgacccacaaaacagaatggagagcacagaaataaattcgtgtactatcagttgattttggacagggtgcaaagaacacagcggggaaagggaagtctgttcaataggtggtgttgggaaaatggaatatctacatgcatgagaatgaaatcagacctgtatctcacatcatataccaaattcaagttaaaatggattaaggtcttaaatataagacctgaaactgtagaactaccagaataaagtataggagaaatgtacatgacattggtttggacagtgatttttttggatatgaccccctcgaagcacaggcaacaaaaataaaaattgatgaatgagatcacatcaaactaaaaagcttctgcatggcaaaaagaaaaaatctacagaatgaaaaaactcacagaatggaagatagtatttccaaaccatatatctggtaaggggttaatatgcaaaatatataaggaactcagacatctcaatagtaagaaagcacctcacttaagaaatgggcaaaggacttgaatagacatttctcaaaataagacatacaaatggccattagaatggctattaaagtatgatgaggatttgcagacaagagatatattgcgcatggcaggaatgtaaattagtacagcatttatggaaaatagcatgacgtttgctcagaaattaaaaaatagaactaccatatgattcagcagtcacacttggatatatatgtatttttatatatatatatatatatatatatatatatatatatatatataaataaaagaataaaatcagtgcgctgaagagatctgtactcccatgttcctttcggtatcatttgcaatacccatgatacagcatcagcctaagtgttcatggataaagaaaatgtggtatgtatacacagtggaatatacttcagccataaaaaggaggaaatgctgtcatttgtgacagcagggatgaacctggagggcattgttgaaagtaagccagccacagaaaggcaaatactacatctctcttaaatgtggaatcttaactcagggatgtaaaatggtggttaccaggggctgggggtgagtggactgggttgcagaggtgttggtcagaggacacaaaatttcaattaagaggaatttgttcaaggtatctattgtacaacatggaaactagttaataacagtgtatttttggaaatcactgagagtagattttaaatgttctgccataaaatataagtatgtgaggtattgcatgtattaattagcttgatctagccattccacagtgtatacatattttggaacatcatgtgaatacaataaatatgtatccttttttttgttttttgtgttttttttttttttttttttttttgagacagagtcttgctttgtcacccaggctggagtgtagtagcatgatcttggccactgcatcctctgcttcctgggttcaaatgattctcctgcctcagcctcccaaatacgtatcatttttatttgtcaccaaacctggtgtcttgacaggtgaaaggagatatgagtatgagtgaaactcttacaaagatagctgagatgatcattgtcagaggttttagtatgtctaacaaagacaagggagtgatttgctgaaatgaggaggtgaagatgtctcaaatttagaaaggcaaatattttgggggcctagagtattgggatagaaccatgtacagggacattgaagtcactttgctgatgatgtaactgggggcaaagtggaggcttaaatatgtgggtttaattgaccagaacagggagggaaagagaaggcattcggttagatgacatgagtttcaaattacaagctgtttttttgttgtttttaatacagggaattttgccgtttatttttaatacagggaattagaagaataatggtggacttaggagttttaggagtcacataaaagggttgcatgataggcagtgcctttggggaggagccaggctttcatgaaagctaagaagttgaggggccattatgtaaagtagttgaagatgggggatagcctatgggtcttcagaaagcctctgggtttctagagatctttctggaagaggttaggaggatgagtcaagtttagaatggaagaggatagatgaagcttgcatttggtagtaaaaaccaaggatgaatgtgtgaggcatgattatttgtcacaagtttccaggtgacactctggcactcagtccttgttgaattaagcaagctttcttactgttttacttggctgtgttaaagtagagtaacaggaaattagacttcccataatgtctcaatagagctgttttaagtttctagccataattggtatgggaatatagctctaaaccttcaaggctgctaccatttctcacattcctatatctagaaactgtagccaggcagcactttcagtgaggtgagtgggtccaggtttgttcaattacttttgtaccaacctaataccttaatagtatttgtcctaatttacaaaaataggtaatgaaggattcttggttttacctcagagctaactgtccattaatggcaacatcccacatttgttgaagcatgattttgttgtttgtactttgacatgcatttgatattttaagtaacgccttgaatgcatcttaaataataatttatatacagttaacactcctgtttgtttttaggaattcttagtgttgccaatttcctaggatgtagaagagcatagtaaaaaaaaaaattattaatactcttaaacaagtgtttttaacaactggacaccattttgtagttaagcctagaaacagaactaatgcaataacccagatcttttcatttattcgtatgtttattttacctggatttactttagttttttgttttgtttgcttgttgtttgagatattgtcttgctctgtcataagtgatacagctagagtgcagtggtgtgatcagagctcactacaactttgaattcctgggctcaagtgatcctcatgcctcagcctcctgagtagctgggactacaggcatgtgccaccatgccaggctaaaacagtgtttttgtttgtttgtttgttttttgtagagacagggtctcactatgttgcccaggctggtcttgaactcttggccccaaagtaatccttctgccttggcctcacaaagtgctgggactacagacgtgagccaccgtgcctggccatggattttgtttaaatttataaataccgtgttgtagaatctctttgtatgtattaatttagacaccttagttttcttaatgatttcataccagtttctcagtaacttcagattttttttttgagatggaatcttgctctgtcacccaggctggagtgcagtggcgcaatttggctcactgcaacccctgcctcccaggatgaagcaattctcctgcctcagccacccgagtagctgagattacaggcatgtgccaccatgcctggctaattttgtatttttagtagagacagagtttcaccatattggccaggctggtcttgaactcctgacctcgtgatctgcctgcctcggccttccagagcgctgggattacaggcttgagccaccgcacccaaccagatcagattttttatgtttggtatttactctttacctctaacactaaggctatgtttccagatgtataactataaatggagcaggggtaaatacaacaagtgatttatggttcagtaaagcaagttagttttaataaatgctcagtttactgtaaatgtcagaaatgccccaggactctgtctattgacaactcttctatttccatcgtcagctcttgccctctgaactgtagactgatttatccaacagttaagtctggttctcaaacttaacctgtcctaagtggagctcctgattttcatcatcccaaacctacgtctctcataatattttgccatctcagtcaataacagcttttttcccctcctgtgcagccagaagccttggaagcatcttttaatttctctatgtcacatactcaaattattggtaaatcttgttggctacaccttccaaatacccataattcattttattttttttaaccattatacttctgtttactctgtttaaaggcatcatcttttggcaaaagaaagaaattgtttcccaggagtcttgtgctttacagtgtattctctagtagcagccggaatgatctttttaaaatctgagttaaaccatgttatttactatgcacagaacttttcagaggcttcccatcttaaaagtaaaatctggagatttacatggccctgtgtgaactggcttcctttcatttctgtgatctctctaccgcacttgctcatctctgtctaaaatggctgtatctttgtcatcttaaggcttgtaactattgtctgtgaccctgtgacccttctctgtgataatccatgtggcttccttcctcacttgattcagagagctctctgctcaaatgatgcttttcctgaccggctgcatcaaagaatgatcatgttcttctgcattccccttaacttgctgcatttttcttcatgggatttaatgtcatttgacttcttgcatattgatttctttgttgttttgcttctttaccactagaatggaagcctaatgacagtgcctggcatacagtaggtagtcagtaactacttcctacatgaaagaatgaagctagtaaatttatgcaaaatgtttgtttctgcctttttaattatcttgcagaaatgtaggaagaattttttaggatcagtttatgtatatatataaactgataagtatgtacacagcctgtagaatgtgggtaataccacctatcatctttttgagcatttaccatgtagcaagtgactgtgctccataatccacatgcattatcttgaatttgataggagagctgagctttttaatcagagtagaccatagaaatatagcttggatgcttttatttcctatatgacttcttcggtgtacttacacatctataagcatttatgggtcaagtaacatactgaaatattttctgaagtaaaagaaatctctttaatcaaataagtggttctcctataggttctcatatcatattcttggtctccagattgagaaggtccttttgtatgcttccagtatactcgaaaccaggaggtagtctgacatctatttcccttcaaggtcaaataattagagaaaggtttaattgacactgttatcgagacagtatcagaagagaaattgaaaaatctctgttgagactctgtaatttgctaggttctgaggatacgacagtaaataagttattaggtcatatacctcagcttcccatttaattaataggcagttattatatataatagaataggtactggttggtatgagactacagaggaagaatacctaattatcttaaaagtggtatataagctgaaaccttgaggatgcttgggaatagctaagaatcatagtgttctaggcaggaagaataacacctggaatcagagaagacagcagaacaagtccactgagtagtaagaagttccgtattgcagtaatgtagagttagctgatgggagaaggtgtgaaaaaatgcatttggatatagaaagccaggagcacgctaaggccctttgctttcttctgacagacacaggagcccatgaaaggcatcacgtgtggaaggaagtgacacgagtcatagtctgccctgcttttctaccacctgaagcatcatataaacctatatcttctgtttcaaatgtaaggaaacatacttctagttcacagtagggatagttgaatggatgaactgtttctggctgaatcttctcaaagtagaatgagcaaaacatggctatattatgagattatctaaggaaagatttttataatcatgtgaattttgaatttctttatatcttaattattccaagagatttttgggaacattaatgagaatagtttacctttagtacatagaacttcttgtcagctataaatgaggatcaaacccaaaagagattaacaaaaataaaagggatgctatttccccaaattagcagaactttttgattcaccgagttctttgttttttaactgctgtctgcctcttaacataattgagtattcagtgatataatataaataaatcacttactaaatgctgatgaacgcttgtttttactaacatctcagcttgtagcatatcttgttgcccataccagaaaccctacccattacctctggctcttccagcttatttacctcttacaaactacttattttaaatatttcctgggtcaatttcatctttttttttcttcctactgctacattatttgtccggactattacagtagtcattacctaactggattgcttgcctccagttttgcccactttggtttcagttattgaaaaggcaaattttgtcagtcacttaacctgcttaaaacccttcagtgactccttgtgttttagttcttatctaatggtttatgaatgtagtgggttacgaatcttccggaagagtgcatttgcactcctgaagtgtgcatgtatttttatgaggagaagatctttagcttttattagattactcctcttttggctaaaaaaagaattacttatcatggctattgaggtcttccatgatctggcttttccctgcctctccattttcatatttttgaaacttttcttgaactttaggctcttgaagtgcttggaattgtcttataatatcatgttttcaggcccctgtgcttttactcattttcctctatctgaaacattcttcccctgtctgaaacattcttcccacccatagtgtcatcagctcctagtcatcttttgtgattcacctctcctaagttgcctctctttttattgctattcctctgtagtcatctctgtgatattgaaatcgtggctttctctttctttagacatcataattccttgaagagccctttttatgtagcctgacaagcagaatttatactgaagtagacatttggaagtcatttagttattgctcaatccttgaaagatgaaactgtccaaagggaaatttaaaagggaaagtatctaatagctgatccctggagaatacaaatgtctctagatttggaagggaagtctctgaaaaacagccagagagaagggaggaaaccaagaaatagtgtcctagacccaaaagtcaataatttccaaaaggtctatatttcttaggaaggccaagtaaaataagtagtgaaaagtgatgacctgactagagcagattcttcatttccagttacagaagctaggttataggtacagtaagctctggacatgttcttttcccacatggaacgttattcgtgttctccactgctgctttgaactattccttttactctctcagcataaaaatccctgctcctttgaagcttatgccttctggttttgtcttcctctgtctgccttcagtgagctatcagtttcttctcggtttttgaggactgctacctgaacttattcttcttcactctttcccaaatctgctgccatctttatttatatgattaacccctcagtccctagcaagtcaaattcccatccgtttttatctacagtaatgttcacctctgcatcactgctgcttcccatgtctacaggcatgccaactcaaaactgttttaccccaaaagcttcagtgaaaacaccttacctcaggttgccgtctttgaatgcttttctactatcttaaacttgttttctttcattgcgccttttcttccttctcttagagacttgtcctatggctcttctactgtcttccagctacaattccctcttgttcctgacatgtactgctcagagccaggagatggataagtagtagtatttcacatgcacttttttctctggggagcagtagtcatacaataattgattaagataaaacaggtttttatcagtttatataagaggtaaagaaaacaatggggtagagttttaaaaattgtcaaaaacaacacattttaccatattaatgatttgaagtgtacggtacaattgtggtaactgtgcacattgttgtgcagcagatctctagaactttttcatcttgtaaaacagaaactctacattcattgaacaactcttcttttcccccttcttcctattccttggcaaatgccattctactttttgcctctaaaatttgactgttttggctacttcatgtcagtggaatcattaagtatttgtcttttgttgactggcctatttcacatagcaatgtcctcaaggttcatttgtgttgtagcatattacagaatttctttcttttcttttaggctgaataacattttgttatatatgtataccacattttctttaaccatttgttgatggatgtttaggttccttccacttcttgaatattgtaatgttgaaataaacatgggtatacaaatatttttttgagaacctgtttttaatatatttggaagtatacccaggtgtaggattactggatcatatgtattctatttttttttagattttttttttttttacaggagttctaggttcacagaattgagaggaaggtacagagatttcccctgtacctccttccacacacatgtatggattctctcatagccagtgtgcatctcccaccagagtggtacatgtctttctgatgaacctatattgatacatcataattacccaaagtccgtagtttatattagggatcattcttagtgctgtacgttctgtggctttgaacaaagtacaatgacatgtatctaccattatatcatacagaatgttttcactgccccaaaatcctctgtgttctgcctatttatctttccttccctcccactccttggcaatcaccgatccttttactgtgtctctaactttgccttttccagcatattatatacttgtaatcatacagtatatagccctttcagcttgactatttttacttactaatatgcattaaagtttcttccatgtcttttcataggttgttagtacctctctttttccattttctggacatatcacagtttgtgaatgaatattcacctaatgaaggacattgtggttgcttccacattttgctaattatgaataaaactgctgtagatatcggtgtgcaggtttttgtgtggacttaggttttcagcgactttctgtaaatactagggagtgcaattgctggatcttatggtaaaagtgtttagttttgtaggaaacatccaaactgtcttctaatatgacgctatccttttacatttttcaccagcaatgagtgagtgtttcttttgctctacatcttcaccagtatttggtgttatcagtgttctgaattttgtccattctgataggtgtgtagaggtatcttataattttaatttgtgtttctctgatgccatatgatgtgtgggacatcttttcatatgctgaattgccatctgtatatctttggtgaggtgtctgttaaggttgttggccaattttttaattgggttgtttgttttcttgtggaattttaagagttccttacactgtctctgtctgtcttgtctgtctgtctgtctgtctgttgagacagagcctcgctctgtcacccaggttgcagtacagtggcacagtcttggctccctgcaacctctgccacctgggttcaagtgattctcctgcgtcagcctcccgagtagctgggattatacccgtgcaccaccacacctggctaatttttgtatttttagtagacacggggtttcactatgttagccaggctggtctcgacctcctgacctcaggtgatccacccaccttggcctcccaaagtgctgggatgtgagccaccacacccagcctccttacacattttagttaatagttctttatcagatgtgtcttatgtaaatatttcctccctatctgtggcttgtcttttcatactcttgacattgtcttttgcaaaagacaacaatttttaagaaacaagtagacaattttaatgaagtctggcttatcagttcttttcttcatggttggtacctttggtgccgtatctaaaagtcatcaccaaacccaagatctagattttttcttatgttatcctctaggagttttatagttttgagttttacatttaattctctggtttattttgagtttatttttgtgaagggtgtaagacctgtgtctagactctttttttttttgcatgtggatgttcagttattaccactgtttattgaaaaagactattttcttcattgtattgcctttgcctctttgtcaaatactgccattgctcctttgactatgtgggtccatttctgggctctctattctgtttcgttggtctgttttgtcagttcttttgtcagtaccacaccatcttgactactgtagctttacagtaaatcttgaaatcagtagtgtccatctgactttttctgtcaatattgagttgtctctcacgggtcatggaatagctcttcattatttagttatttgatttctttcatcagagttctaaaacatttttcctcatatatcttgtactaattttgttagatctgtacttaaatatttcattttgggacacgctaatgtaaaatggtattgtgtttttaatttcaaattcaacttatgcattgctggtttacaggaaagctattaacttttttatatgaaccttgtatcctgcagctttgctataatcacttattagttctaggaggtttttgttgtttttctttttctttttttcaattcctgtctatgttctacacatatagtcatttcatctgcaaacaaaggcagttgtatttttttgttccccgttagtataccctttatttccttttcttgtcttagctaggacttccagtatggagtggtgaggtggggatattcttttcttgttcctgatcttagtaagaaagtttctagtttctcatcattaaggatggtgttagctgtatgttttttgtaaacgttctttatcaagttgaaggtgttccctctattcctagtttactagtttctatcatgagtgggtgttaaattttgtcacatacttctctccatctatggtatggtcatgtgatttttcttctttagtctgttgatatggtgaattgcattaattgattttccaatattgaaccagtcttgcatacctgggataaatcctactttgtgctggtgtatacttctttttatacattgtagtaaaatttagtttgctaatactttgctaatacaaagatttttgcatctttgttcatgacaaatatgggtctgtagttttcttttctgataatgtctttgtctggtttgggtattagagtaatgctgacttcatacaatgagataggagcatctcctttgcttctgtcttctgaaggagattgtagagaactggtgtggtttcttccttaaatgtttagtagaattcatcagagaatccatctgggcctgatgccttctcttttagaacattattaattatggatttaatttctttaatatatgctttttaatcaagattatttcttcttagagttctaatagattgtgtcttttaaggaattgattcatttcatctaggttaccaaattcgtggccgtaaagttgttcataatatcccttgattatccttttaatgtccatgagatctgtaatgatgtccactcttttcattctgatattagttattttgtcctttgtctctttttcttagcctggctagaggcttattgattttattgatcttttcagagaactagttgatttctttgatttttctctattgatatcttgttttcaatttcattgatttctgctctaatttttattacttctatttggatttaatttgctttttctagtttcataagttggtagctcagataattgatttttagatcattcttttcttttcttttttttttgagatggagtctcgctttgtcgcccaggctggagtgcagtggctcgatctcggctcaccgcaagctccgcctcccgggttcacgccattctcttgcctcagcctcccaagtagctgggactacaggcgcctgccaccacgtgtggctaatttttttgtatttttagtagagacggggtttcactgtgttagccaggatggtcttgatctcctgaccatgtgatccacccgcctcagcctcccaaagtgctgggattacaggcgtgagccacagcgcccggcctagataattcttttctaataaatgcatcagtgttgtatgtttctttctaagcgctgctttcactgtatcccacaaatttggataagttgtgttttcatgatattttcaatttataatggtattgggacacaacccaataagtaagtttaggagcatttgtatgcataagcacaattgttgacattattttgaacaaattcttatttgttagatcaattaagtataagaaaaataaaaggttttattttactttcagtgtttccttcttttgatgctctatatatgtagatttcagtttctgaacttcccaacacttattgcaaggcaggtgtactgacaacaaatttccttaatttttgtctgagaaagtgtttctttttaacttttgaataataatctcacaaggtagagtgctaggtttatggtttttttttctctcaacactatgaatatttcactctttttcttgttggaagtcacatgtattttttcttttttttctttttttcctctacaggtaaggtgattttttccctctggcttacttcggatttttttcttatccttgaatttctgtaattacaacgttttatgcccagatgtagttttttggcatattttcaagctcagagattcttcatccatgcccagcctactaataagcccatcaaaggcattcttcatttctcttacagtgttctgttttttgtttttgtttgtgttttatctctagcacttccttttggttcttaggattttcatctctacttttttaacatgttgtttactcagttcgttagggcccttagcatattaatcatagttgttttagattccaagtttgataattccaaatccctgctgtatctggtcctggtgcttgttttttaccttttattatgccctgtaatttttttcttgatagcttggacatgatgtactaggtaaaaggaactgttgtaaatgagcatttagtaatgtggttgtaaggtgtagggagaggagaagagttctgtagtcttatgattaggtcagtctttttagtgagcttatgcctctggactgtgaacttcacaagtgtttctcaatcccacccctccctcattcccttagttagaacaagatagctataatggcctgaagttgggttatttctcttcccccacatcattttggctttgctacaaccccagcaggttaggctctggttaactagtttctcctgaggacaaaccttgttaagactggaatagtctagtgtacttgaaaatcatttctctttgcctcccctgctgagggttgaggatttttctcctatatttactgtgagaagctggtcaattgcctggatgtaaaacttagaaaattgtagggctccccctataattgggtaactctggagtttttagctttcagagttgtccacactgagccttcatcaatttgtctattacacttcaggatttcctaccccgtggaggtttctgcttgtgtttttcatctcagataaatggtgatgctatgtgttcacctgttctctgctctcacaggcagtcatttgccctgtgacctcacttatcctatctcagatttgtttatttttaagtttgtcattttttacttgttgttaggatggagtggtgacttccaagctcttcatatgtggaactggaggtaattctatttcaaattttttgagggaccttcatgttgttttccacagtgcctggcaccattttacattttcaccagtggtgcataagggttccagtttctccatatcttcaccaatacttattttctgtttttttaatggtggccatcctaatggtttcagatgatgtatcattgcagttttaattgacatttctccctactgatcagtgatggtgagaatcttttcatgggcttattgcccatttgtatatattctttggaaaaatgactattcaagtcctttgtccactttttaactagattttttgttgttgaattgtaggagttatttatatattctggatattaaccaaataacagatacatggtatagaaatattttctcctgttttgtaggttgccattttactccatttactgtttgctttgtagaaatttttgagtttatgtatccccagtttgtctatttttgctttggttgcttgtgcttttggtgatctattcaagaaatcattgccaagtccaatgtcatgaagctttttctccatgttttcttgtagtagttttataattcgatgttttaagtttaggtctgtaatccagcttgagttcatctttgtatatggtgtgagataaggctccaacttcattcttttgcatgttagattccagatttcccaatacagtttgttgaagaacctcttttccctatttctgtgttctctcttctgctcacttggtctgtatatctgtctttatgccagcaccatagtgttttgattactatagctttgcaatatctttagaaatcagggaatgtgaggcctctagctttgttttttgtccagattgttacggctattcagggtccttcaagattctgtattaattttaagattttttttttctgtttctgtagaaaatgccattgggattttgatagggattgctttgaatttgcagattgctttgggtagtattgccatcttaacagtactaaatcttccaattcataaacttggatgtctttccatttatttgtattgtctttaatttctttcagcattgttgtataattttctttttcttttttttttttttttgagacagagtctcactctgtcaccaggctggagtagagtggcgtgatcttggctcactgcacctctgcctcccaaattcaagtgacaactcctgcctcagcctcccgagtggctgggattacaggcgcgcgccaccaagcccagctaatttattttgtatttttagtagagacagggtttcaccatgttggccaggatggtctcaatctcttgacctcgtgatcagcccaccttggcctcccaaactgctggggttacaggcgtgagccaccacgtccggcctatgttgtttaattttcaatgtacatgtctttcatttgcttggtgaaaatattccctaagtattttttactctttgatttcattttaaatgggtttaaaaaattaatttcctttttggattcttcatttttagtatttagaaatgcaactcttttcttaatattggtttttatatcctgtaactttactgaattcctttattctaacggttttttttctttttggtaggctagagttttcaacataaaagatcatgtcatttgctaacagaagtaattttacttcttacttttctcatttaatacctttcatttctttttcttgcccagttgctaactctggcaggatgtctaacagtatgttgaatagaagtggtgaatgtgtgcattcttgttccatttgtgatcttagagggaaaactttcagtttttcatcattgaataacattagctgtggtctttctatatatggccttcattatgttgaagtaatttccatatctttctagcgaattgagcgtttttgtttttgtttttttgagacagaatcttgctcttgtcacccaggctggagtgcaatgatgctatctcacctcactgccagctccgcctcccgggttctcaagtgattgtcctgcctcagcctcccgagtagctggaattacaggcgcccaccaccatgcccgattagtttttgtatttttagtagagacagggtttcactgtgttggccaggctggtctcacactcctgacctcaggtgatccacccaccttgcccttctaaagtgctgggattacaggcatgagccaccctgtctggcctttttttaaatcctaaaagggtgttgatttttgtcaaatgcttcttctgagtcagttgagattattggtttttgtcctaagaatgcagtgtattaaagtgatttttttgtatgttgaaccatccttggattttatgaataaattccagttgagaatttatgaaatataatctttttaatgcattgttgaattctgtttcttggtattttgttgattttttttgcatcagtatttattagggattcttttttcttgtaaatttgtctgatttcgatatctaagtaatgcttacctcataaaatgattttgaaagtgttctgtcctctagttttttcaaagagtttgagaagggttgttagtttttaaatgtttggtagagttttcagtgaagccctggcgttgttggacagttactgattcaatctctaatagttataggtccattcagaagttgtatgtatttgtggctcagtcttggtgggtttgatgtgtctatccgttctcaaaggttatcaaatttttttgggtcatagttgttcatattagtcttttaaggtcctatttatttctgtggcagcagttgttgtatcgcctttctaatttccagttgttgctgtttgtgtctattctcttcatttcttaatctaagaatttgccagttttgttgatcttttcaataaaacagctactcctaattttgttgattttttttctattgcaaaaattttctatttttctctattttattttagctgtaatttatttttattttttttattttttggtaagtttgagtctcatttgttcttcatttcctaattccataagatgtaaagttaatttgttgatttaaggtttttcttcctttctaactgtgaaatatgacactgtaaaacagattttcattttacagatgaattatgtaaatatttagttctacaattttacttttttttttatcatatatcacgcattctggatattgagactataaaaatgaaaaaaacagttcttttcttttcttttttttttttgagacagagtctcgctcttttgcccaggccacagtgcagtggctctgtctcggctcactgcaagctccgcctcccgggttcatgccattcttctgcatcagcctcccaagtagctgggactataggcgcccaccacggcgcccagctaatttttttttgtatttttagtagggacgtagtttcaccatgttagccaggatggtctcgatctcctgacctcatgatccgcctgcctcggcctcccaaagtgctgggattagaggcgtggcgtgagccactgcacccggccataaaacagtaattgaaggttaacctatatttcaaacaactgaaaatactgatttgttcatatttattttttcatgaaaatcgtcttgttctatatttaataggtttttgttcggttcatggtactaatgagttcacaattgtaggtttagtcttgaaataatctaaattcacttcatcccattgtaacagaccctacatcatactgaatatagttgtgtcacagatgtctcttacagtctatttctacaaggcctagaactatttaggataccgttgctcactcttacaaattttaacattaaaaataactttgagatggaatggagttttgcaacgtctcagaacaaagagactccacttacgagaaattactaagcagtggttcctagctttatagactaattatataagccttcagttgtttctattttatatctgttttttagattcctcacatgttcattctgctttaccttctgtataatataaaggtcactctacttacagtcacattttccttttaatctttccgtttttattttttattctttgctttgttcaccattagtttttatattgcatctcacagttcatgtttcttttttgtcatttctgattctaattgtaattctaatcttacttgtttggcgttcactgtcacatcttcactttctggcagctgtttctatggcttcatcttcttagtgcttgtattcattgcttatattccagttgtcttgtaaattcatttttttagtgaactaagccagacacggaaagacagatatcacatgttctcactgatatgtgggaactaaaaaaacattgaacacaaattttacagctgacacacatatgcctgccacctagattctgccattaatacttacattgctttatcgtataaccatccttgtatccatcaatccatcttaatttttatgcctttcaaagttaattgctaacattagtacacatccctctaggtgaaaccatttttaaactgattgctgtcaagttgtctagagtaaactctgatcttccaagtatgacttattccataggacttctgtttgtagcactgtcccattaattcaatcatagaaataaataattggaaagtattgtctgttttaaatggataagtattttcatgtgtctgactttagaggacttttactagaaggtctcacttgaccttcattgctgactaaataagaaaagtttgttttattttaaaaatcaacacattataacatactttgttttttgagtaataagaaaagtcaatggaatgtgaagaaattatagcaagtaagctgttgttcctcttctaggaattttgattatgaacagctgataaggtattactaagggatctcatcagggaaattcctttctttccttctttttcttttgcatcctctccctttcctcactttcttttcccctttttcccttttcccctctcctcttcttttctttaatagtacttggggaaaggtataccttttattttacggatttgctcagggtaaagagagagttaagaggccaaatgattagatggcagggtcactggagggcagagataaataatagatcctaaactaagggttggcaaacattttctgtaaagggcaggtggtatttgttttaggttttgcaggcctaaagtactcaactctgccattgtagtatgaaaaacagccataaactatatagtatattgtattagtcctttttcacgctgctgataaagacgtacctgagactgggaaaaaaaaaagaagtttaattggacttacacttccacatggctgggaaggcttcagaatcatggcgaaaggtgaaagacacttcttgcatggcagtgacaagagaaaatgagaaggatgcaaaagcggaaacccctgataaaaccatcagatctcgtgagacttactaccacaagaacagcatgtgggaaactgcccccatgattcagattatctcccagggggtcactcctacaacacatgagaattatgggagtacaattcaagatgagatttgggtggggacacagagccaaagcattatcatatatagtatatttataaatcaatgaacttgggtatgttccagtacacttgatggatactggaacttgaatttcttataattttcacgttacaaactattattatttttcaaactttttccagccatttaaaaatgtaaaatattctaagcttgagagacataaacaggtggtggactcgatttgacttacgagctatgatttggtgacccatatggtacaaggatttcccttgcgcaggaactataccaaaaagtcgttattagtgtatacttttccaacgtagaggcccttttatgtgctctaaattttgtatgccttttacatatcctaaattagatagtgatgcagatgaggtcagataaattaaggtgtcattggagtgaggaaaaaagaagaatgcttaatatagttgattccaccattaacttggaggttctggcatggcttcctttagtcctgtctcatcagtgtagctgctatttgttaaacttggcacagaaaggcagatcaaatatagagggctactttcagatcctcctcttaatagttattaaaagctcaagtttagtagctgagttcaaatctcttattagatgtatgacttatgtaatttctctgagcatcagcagaatgaaggtttatagtgctaactcatacacttgtgagggtgatagtaacaattacaacaataatagtagtagctaacactttcatagtgcttagtatgtgccaggcaatgttctaagcactttatatatattaacacatttaattttctcacaattggtaatgtgaagaagaataatactctcaccatgataatgctcgtagatactaccatttaaattacgaggaaacttacgtccagaaagatcaagtaattcattcagggtcacatagttaattaagaggtagagccattatgtgaacttgggcatctggcctcagaatgcgagctcttaactgttaaggtttattcccctctaaagtgggaatgtctataaaatgcatagcacataggtcctcaacaaattagagagaaattaactttgcagaatatagtggttccatttcctcaagaaacttggtctgcctttgtggtaccagatagatgcataaatgtgaggttcacgttatgattcttcagatttttttcccagttgcacattagttatgagatttttttccatagaattcttcagtattactcatgttaaaaaataattattttgaaatgaatcaccttctgcaaaacaatatagtcaaaatgacttagactctgaagctgaaagactcctggactcctattcttgtcttggttctgtactttctttgagatcttggtttcgtgatttgactccagttctatttctctctttggctgtggactgaagataatcctcaatgtcatggtattcaaatgagataacccatgtcaaagtgccccgcagtgtgtgtaataagttatcaggcatccagcaaatactagtttcttgctcacctccctattacataaaataactttaaaattagaactgaagggactcataaagctgggaaaactgaggcccagacaattgtttccctaggatcctacagctgcttagggacagaaggatgacacttaatgcagatcttctgatttttcagtctcgttctgtttgtgctgatcactctcctcctatgtagtatataaagaagtactatgtatctgacaagttttggggaggttattttagtataaaagctcacattaaaaatatctattttggtattttgacttttgtaatttttttaaaaatcagagacaatttagtaaatctcggggccattcaaatcatgtatatgaagttttataactgctattgttttccccttatagttattaatttttaatatgcaagtagcatccttactatggaaagaataaataagaaatcaaaagatggaagaagttttaaaactcacttaatcacatcatccagagaaaatgctattaatgctttgaaataacaatgggttcatcctacacctgctactttttaactgacttttgtcagttagtgatatatcaggaagactaggcagttctttgtcgaattcaaatcttgatagtttttattttattgtgtgacctattatcagttcatttaagtaatcttttattagacatgtttttttcagatatagaaacaatgcatttttgtaaaattgtcaaattattttccacaagtaggatctcattcacacggtattcgtgtttttaagactttcgatacatgttcactgttttcctccagaaaggaaatacctacttacattttcaccagggaagtcactgtagtttgggagaacatgacattatctccctttctttactgaagggtagcaatatatattttaaattttctagattctgcatttccattttatttttacatgttttcactttcatattttgcatagtgctaaatctgtgataacagtttttaattttcaggtggggtttatagcttcatagatagcaaaatgtctttaagtcatgtttatgcaatttttacatgtgctttgtgggttttcttttttctctgtttgcatgcagtgagtggtaaatttgcatggaacatttgaaaaataagcaccagaatgaattgaatgtgtgtgaattatcactttttgtcacctacctggacagagagtgaaagttcttctgttgagacaaaattggatctcgtgtgtttcttcacttacttgctgccttgttaattgttgagtttctcatgattagcaagatgtaaactctggcattggtcatctagtcctacatgttagataattctgtgaatgttttgaaaatcagctgaactatttttcttataattttgattctttgtagttgttatttccatgcttgtgaatttgggaccaaaaggaatggctatgacttatgtttctttggatccagtagtttattctactgaaattatggtaattttatcagttagtagaagcatagactctttagtgttgaatataatgtcatctaacttcttacatggtcacataattcctccctcagttttggtagctctcctgaaacagccataataggacattaatctgtgtactttaagttgacagagtaaaaggaatataagatttcacgtgatggaacttaaaatattccatcttgtgacgtggaactaatgaggaggtttagtgacaagttttagatttaagattctacactttggagcctctttttctttttctttttggtttttgtttgtttgtttgtttttgagacaaagtctagctctgttgcccaggctggagtgcagtggtgcaatttcagcttatggcagccttgactctcaggctcaagtgatcctcagcctcccaagtagctgggactacaggtgcatgccaccacacttggctaattttttttaaaaaagtttgtagagagtagcctcactatgttgcccaggctggtgttgacctcctgggctcaagtagtcggcctgcctcagcctcccacagttatgggattgattacagtcatgatctgcctcactcaggctgcagccgctttctttcagtgtaacactatctttggatattccacttacaaatttatttttaagtctcccatgttgttgataattgggaaaaatagtttttattccagatagatattctgtgttaactataagtcaaatgtttacaagctgttaaaaatgaaatactgattatgtaaaagaaaaccggattgatgctttaaatagactcattttcctaatgctaatttttaaaatgatagaatcctacaactcttagctgtaaaccttgtgatttttcagctgttgtactaaacaacttaagcacatataccatcagacaagcccccctccccccttttaaaccaaaggaatgtatactctgttaatacagtcagtaagcattgacattctttatcataatatcctagaaaatatttattaactatttcactagtcaggagttgtggtaaatagtgcatctccattttctacttctcatcttcatacacaggttaatcacttcagtgcttgactaacttttgccttgatgatatgttgagctttgtacttgagagctgtactaatcactgtgcttattgtttgaatgtttggtacaggaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaaggtaagatgttttattttcaattgagaattgttgcctgaaaaccatgtgggagatttaaatgtattagtttttatttgttttttcttctgtgacataaagacattttgatatcgtagaaccaattttttattgtggtaacggacaggaataataactacattttacaggtctaatcattgctaattagaagcagatcatatgccaaaagttcatttgttaatagattgatttgaactttttaaaattcttaggaaaaatgtattaagtggtagtgaatctccaaaactaggccacaacatctatttaagttatagaataactggactaagtatctggcatgagttctggaacctcaggatgatgtgatgaaagaagcagaaagaggaaacagtgggttttttccatttttgaaggcaagacaaaattttgtgatagttatgtgagaattctacgtttccttcagatatatgcttctcactctccttccggacatttggtacagtcatgctgccaaggatcatgacctaccaatgacagtcttcactcaggtcttttgttttctaaatggtcctacgtccaaaattcagaattcgattaccttgtcgctaatactaaaactccaagttattttcttcagtgaaggtaattagtaacaaagtaatcaaatttttgaatgactaccagggcttagcgcccctccactctcacccctacacacacccagaggcaattgtattttaagagagaaagctttttttttatgacatacaagtcagagaattttagaggcatttgcctctaaaactttcactaacatcatttgaatcaagtttgaaagaattagtgaagtggcattgtgttataacctctactctgtttccacaataaaattattttcgtcactttacacaactttgttgcttcagagtgtataattctgtttcatgaattagttcacacactatgggaaaataggtaaatgttgtctgtatatatagtgtgtcagtataatgtggaagctgcattgactttattgtacacagttctccagtaagtgtgcaccagagagtaccagtaactgaatgtagagtgctggcacagtggaatgcagccagctgcgggggatgtggtacatgaggaatgtgctcatctgctcttttggccacgtgctccatcttagaggtgcttattgtgtggctttatccagtctttatgccccctcctctttttgctcaagtctgcattatagcagttgtgacctttccttatccctgttttctaatatgctactgttactgttccctgttcgttactggtttttttgtttttgtttttgcattgttctatagttactattgtatattggaaattagagatgctttctgtacactagtactcttattttgattattaattatgtttgttaacactaattacaaagttgcataagtattaagtagtctgcaccaaactgtttttgcgtaggaggtttttaagtgcaaaatttaaaagattgagtattttcagggacacatttatcacaagaaatcttataaaaatgtctttctcagtagaacacctgtatcaataaaccaaactttttgaatgttcatatctaattacagtgttttttgactaatttttatctatatacctgaaaaattcagtttaacatattaaacactacaggccaggcacagtggctcacgcctgtaatcccagcactttgggaggctgaggcgggcgaatcacgacgtcaagagatcgagaccaacctggccaacgtggtgaaaccccctctctactaaaaatacaaaaaaattagccagttgtggtggcgtgcatctgtagtcccagctacttgggaggctgaggtaggagaatcgtttgaacccgggaggcagaagttgcagtgagccgaaatggtgccactgcattccaacctggcaacagagtgagactccatgtcaaaaaacaacaacaaaaaacactccttggaaaaagtataggtacattctatataggattagtagactgtcagaatcacttgaagatgttccgaaagcatgacatatcaacaaaggacatgtgagtctagaatggtgatccctaggacaggccatattactgcatgcaaagcaagtctttgttaaccttatgacttgctcaggaagcaaagtgtttcatgtcctaataggatagtagtattttctgttatgttacattttaggaaattaggagttttgcattgtcttgtaagaaggtattttaaaaattttcaatgaaaataatgagaaataggtttccagtggttttatgcttttggggaagaggttactgatgtttagcaaaagatgcttatatattcttaatagaacaaacctgagaattagttcttaaagagttaaggcccataaaagaaactgtaagtgttggtactcttgtagctgggccacagatcagatccttagtatgataaaatttggtatttttgtgcttcaatttttggagaccattcaatgatcacttacattttatattgtctttcattgtgaaacatatattatagcagaggtgggagtcattaaaaattctacatgttgtacactacatgtataagggtatatttggcgcaatggaggtaggattgtctgtgtgcctctaaaattaacctctcaagtagttaatctgatgatgacaagtatgtcactttattgataaaagggagaattaagactattctcagtattatgttggtcagtacacaaaatatatcatttgtttttacctgtgaaatgaaatatctttcatcctattagccagaagggagaaagccttggcctgaaaataacacttatctcaaaaagttgggaaatgtggtccaactctgtgcccaggaaaagaggaaatagattttgatgactacatagtctctgcactgcttgccagctcataagtttacttctttgcactgtttgttttcattgctcaaaaactattttctgtcactctatgagatttagtctaacctgattcctggctgtggaaagcagtttctacttaagagccgatgagaaatggtatattcttctcaatcactcacagaatgactaccctggaacaaactaggaagacccaaaatgaaccagtttgattttaatacatacatagatgctgaaggagcctttttttaagaccttgccttcttagtctttggagaacagagtactgaaacaagaaaactcacagattagtagtatttctgtgtgttctacagtgaggttttaagagctgtattatgattaatcagtacatgacatattggttcatatttataattaaagctatacattaatagatatcttgattataaagaaagtttaaactcatgatcttattaagagttatacattgttgaaagaatgtaaaagcatgggtgaggtcattggtataggtaggtagttcattgaaaaaaataggtaagcattaaattttgtttgctgaatctaagtattagatactttaagagttgtatatcataaatgatattgagcctagaatgtttggctgttttacttttagaactttttgcaacagagtaaacatacatattatgaaaataaatgttctcttttttcctctgattttctagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcgtaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccgggtaagttgggctgctagattaaaaacctaataatggggatatcatgatacagttcagtgaattcattttaaaagtgactgaaaaaaatgataccatatagcataggaacacatggacatttctgatcttatataagtattatacttttgttgttcctgtgcaagtttatagatgtgttctacaaagtatcggttgtattatataatggtcatgctatctttgaaaaagaatgggttttctaaatcttgaaaactaaatccaaagtttctttcattcagaagagaatagagtgttggacaaagaccagaacaagagaaatgtggagatacccaataataagtgtggatgtgcagtcttgaactgggagtaatggtacagtaaaaccataccataaaattataggtagtgtccaaaaaattccatcgtgtaaaattcagagttgcattattgtggacttgatgaagtgaccatggcagatcagtgcctgttgccagtaagagttgagtcctgctgggccacttagaatatccctgtgtggacggcactgcctggctgtggtagtttcttcccacttaaaaattcatagagacaactctgggtcttggaacttctggaaaacagcagctattccaaaaatctggggattagtggtgcctgtaacatcaagtccagggagattgagcagggaaatactggaaactcaggtactcatcctaacttcctggttttccagatggggttgccatttgttccttttctttcctccacaagataattttagtgtatctgtttaagaatataagagtggccagaagacagaaagcagtcgtcagtcacatttcaccaaaatttacatttgtctcaggtgcattatcgcagagctttattgtatttctagtattagctatccctgtcattgctgctacttttttatcatcttcaagtaaaatttaatgtcaacaaaaattaaggtagttaataatactatagtatactagtaaagttgtctgacacagacaactaggaaatgtgatttttactttaaaatgtattttagttttagaatgtctaaattttagttttagaattgtctaaattcgagaattcataaagctgtagcccggtggaaaaagttatttgacatctcagaaattaaaaattgcagagattttgtgtgttttttttttttttgttactggtttgttttttttttttaatgtcagatatgtttatagtgttggagaaagattctgcattatttaagcaactcaggtggttttctagcagagacaaaagggggctttaactgcctgaagtcattattattgcttgctttctggtaccctttttatttcacttacatagttttgagacacatgaataattaatacacttaatgactgatcataaggcagccagcaccttactttacatagtttagcagaatgatagggtattttataagaatgtgagtgatgttttatgaaaggtatgttgaggtctgtctatgactatccattgttggagcagaactgcaaatgccaaagctacatactttatgtttggcttcttgaggtgagatcccttcagctgtcttcatcaaaagctatgtctagcctttaaaaggcaatgaaattacactgtaagaatcattccagggttcaaaaaattgtctaccttccttatctgtctttcgctcagaagtctactcagtcttattttcctcagtcccccatttttttctctagtaaagcaagactaaaaacaaaagtttaagtacttggtatatactttattctatattttaaattctattctagaattttaaggaaacaactgcttttaaagccttaggtgttagtgtaaaattaactgtgagctctttaattatggtaacttgtttttagcaagttctgcttaattatatcaaaattagataatatagtgtggcctatcataaatcaggattcactagatagtatatgtacttgaatattgccagcccacaaaagcagttcacttcagaaatcatgtgtgttaggcagtttaataaactgtgaaaatagaaagagatgatgcttacagagaagcttccttaggggctctgaatgctcacactaagcagattttactcttaactttctttctcccttgctttttcttccttttcttttttttaaaaaaataacagaatgtgaaaagactagaaaaaccagcatcgaaataggtcttataagtaaaattgataacctgtgtaattttttgaagtaagtattcacagcaggtgatgattatgataaagccacatattttagtaacacatagtagaagttctataatagaaagtggtttaagattattctctcatatgaaagctcaaaagtgatgaatttttcaagatcttatttcccaaggatctctgctttttaagcctcattcttatatatcacagtgaacaaactagtggccacttttttatgacttgctaattttggaattgtatagcagggttgggtggaaaagaagaaatgagaaactttgtggtaagcttaatattgataaataaaattatgggatcctaggctttaagagctaaaagaaaccttagagttatccactccttagtttagaaatcaagcccagaaaatagtgacttcatatatgagactcttgtatgttttctgttgaggagtggtaacttgaattaataattgtggatttttttaaaaaagaaaaatatattcattgcttttatatattgtgaaattcaaaccagactagcagcttttttcctgaggtttttagagaaattgtctttgatgacaagagaagaattcatgttgatagtattttcactaatctctgattgtaggaaacactatcattttattactgctaagacagaaaaataccagcaattcattgtaagatgctatcatttgtatggtgtaatctgatttcagagataatgtgaaaaaagtgaattttagaatcaatagaatataagttgtctcttcacaaataccttagaactgcttaagaacacccccaccctacccgtttaacttactgccatagttcccctaggacttattttcagtattttttcgttattgttccttagaaaacagtacagtgataaacatgagcttagacttcacctttcatttgaatgacattcctaatgtgatgaggtttttacaaatatgtaaaaccatatttacaaatttacatttttaatataaatatgtaatttaatttaatatgtaaattaatttaatttaaatatgtaaatatttacatatttacaaatatgcaaatatttacatatttacaaatatgtaaatatttacatatttacaaatatgtaaatatttacatatttacaaatatgtaaatatacccatttgtgtgttcttttacaagtagataatttctcatttttcttagatgaagcacttccaatgatagtatgtattaagattttttaaattacttcttaaaggagaagatagaggttataagtttatggaagaatatagtattgccatcatgaggtccctcaaactgccttcacatctgaatgggaaaattgtttaaaaaaaataaataaataaataaataaaatccagggccctaacctctagaggtttagattagaagctgtattgtagagcctatgaatctgaacttctggtaatactccacaaatattttgataaagccagactccaatatttgggaagatggcctttggttcagctcaggtgggggtgtgtgtgcatgtgtgtttatgtgtgtatgtgtgcatatatagagagaaagagaaaggccattttgatatacaagtatgtttatgtgttttggaaactcagatttttaagaggatcatggggacagcaagcttggaatagaggatgatgatgatgtgaaacttggttccaattagtcagggagttctagcatttcacataaatatctaaaaaccaaaaggaatggctgagatgtggaattgaatagggaagttcaaaaataggaattagcacagataaaggtgattggcacagataaaaagccccactaccaggaggttctgcaaaatcccctctaaaagtcactggccctttttatctggtttctaatagcctagtctaacccagcttccagcattttcagctcccagcttccagcattggtgaacactcttactagtgaaacatgaacgtaattcttttatttattcattgactcacagagctttaaaaatgagattattctgtgctgcactaggtatgtttaattttgtcttacacatacactatattgtggttaacatgtaatttccattgttctttcttgtgatttattctaattgaaatcaaaaatgaaaccaagaaatatgcttggtttatgccctcaaagtaatttctcagaaactgaatgagagaatgaagcctatatatacatagatcctcagcattatataataatttaagacaatgaaacatcaaacttagtattacatgtgaggaaaatgaaatctaaaagagattccagcctacataaattaatggcagaattggaaatagaagtcaggattccaggtctcatggacgaacgtgattatgtgatttggtgttacccaaacatttaaactacatttgagatataacagacttttcttcatgtgtttatcgtgaacatgaaaaaattaatttggataatctggaaatctcaagcaatagtttaagcctcaagttgactgaagtagttgaagctagcctttctttctttttcctctttttttttttttttttttagacggagtcttgctctgtcacccaggctggagtgcagtggcgcaatcttggctcactgcaagccccgcctcccaggttcatgccattctcctgcctcagcctcccgagtagctgggactacaggcgcctgccaccatgcccagctaatttttttgtatttttagtagagatggggttcaccgtgttagccaggatggtctcaatctcctgacctcgtgatccgcccgcctcggcctcccagagtgccgggattacaggcatgagccaccacgcccggccttgaagctagcctttcttagaaatcccaggcattcttaagtattagaggtctcttttatctgattattgcttctacttaaatattcatggtattaaggaatttttttaaaaaattatgaattgatttgatgtaatagctcagaaaactataagattttaagtgataaggttttccttttgattcctgtaagtctagtaatatcatattttgatattaagatgtcatcctgctaggtattctgcaaatgctttgatatcaggtcagattttttttttaaaaaatgaactccctaggatttcatcatcatggccaattaaaaagttcagaaattaaaaatcattttatccagcaattgatgaaatcaagagtcttaaagaagaggaagttacgcagtgaagaggtagatatgattatatccaggatatttttgtttatttttccccagtaatctctgtctgttgctagtctccatgttaaataaatacaacatacactgtacttttaaatatacctaaaaattggcctggcgcggtggctcacacctgtaatcccagcactttgggaggccaaggcgggcagatcacaaggtcaggagaccgaaaccatcctggctaacacagtgaaaccccatctctactaaaaaatacaaaaaaaaatagccaggcgcggtggcaggcgcctgtagtcccagctactcgggaggctgaggcaggagaatggcatgaacctgggaggcggggcttgcagtgcgccaagattgcgccactgcactccagcctgggcgacagagcgagactccgtctcaaaaaaaaaaaaaaaacaaacaaaaaaaaccctaaaaatccacgtgtgtattgtaaataaattcaggcatgcatgcacgttctccttttcagaatgtttagacatagtcctccaaatttcaaatatcctaatgcatttaaaacaacttctgacttaaaaaatacagttttatggtgaggtttgggtttaaacaacaacatacaattttaaataatatagctattatgtaaagaatacacctttacagtttatttgttaaatcttttttaaattgaccgaacaattgatggaggttatttttaagaaaaagaattatcagtacagctgtttatgcaataatggcctttatcaaaatggttattgctaaattttatgtgttaataatttaaaataaaatagttttaaaggctatttatgtattctgtttttactattttatttattttaatttttgagacagggtcttaactctgtcacccaggcctggagtacagtggcacgatctctactgactgcagccttgacctcccacctcagcctcccaagtagctgggatgacaggcgcatgccaccaccccccactattttttatttatttatttatttatttatttatttatttattagttttttgtagaaacaaggtttcatcatgttgcccaggctgatctcaaactgctgggctcaggcaatctgcctgcattggcctcccaaagtggtgggattacaggtgtgagccacggcgcccagcctttattcttaagtggtacagtattttatgaaatcacttatgtgtaccagaatggtaatctaaaataggtaataacaaaatttttgcctacagaattcagttaccaactacttttcaaattattctttttacatatttatatttgaacacattctgactctgaaaaatgtatttgttgtaaaaaatggaaaaatatggaaaagaataaggaaaataaaaatcactcataatcctaaaaaaaaaatttttggtcgtcattgaagagagtgagtaaagcatagtagttaagagcttgtttcctggattagtatctctgttccacaacttactgtgacttactgtgacttgaagttatttcacctttcagtatcttggggtccttatctgtaaagtggagttaatgtttccttcctcataagggtgttgtgaagattaaattagttgctatgtgtgaaatgctacaaaagtgctatatattattgttgctgtattcatggaatatttttgttctataatgctatggtaggttttcagaaaatattttagaaccaataaaataacagcaacaacagctagtacttttaagcactaactttatgcagggaattaatctaagcagttcatacattaatttattactatattattatggttattttacagatgaaataagagaggtaaagttgtatgtttgcatttacaatagaacatattgcattgcattacattcttttggcaccaaggtggggagcatagaatagagatcagtggaagtggacagacatgtaatattttatggagaataaagataaatttgcttcagttatcatttgacatgtcttaggtagagctaagactagatagaacacagggcctctcaatcctgtagaaattcaccaccacatcctttaaaaggttttacattgataaggagtcagctctcatctatgaatgttagtggggaaaagctgtagaatgcacagtctaaataccagataaccttttttttccccactttggaatacattatatttgataaaagcaagtatacctttggatgtaaaggtaaatataaacactgacttacatctttaacacctagccagttgggaactggcataaggaaactcagaatggattacatggcaatatggaatgttggcctggtcccacatttgagctaagatgttaattctaattttagtctcctcagaattctgtatactccgtagcttgaaacaggtttccaactgaaactatttttttccccaaggttattttcacatctacatttgtttgactctagatcttggaactagtctatatcaagttcctttggggacacaaaattgcaaatctgttgttcagagagcaaaactattttaaaaggtaacactcgttctcatatattcttaataagccttcacaacttacagtatgttgaggaaactgaggcttaattgaatcgcgtgctaaagtttaaaggttaaaagttatggtaagtgagagttgggactagtaaggtgaattctgactgactcttggtctttccataacaaaacattgtctaaaagtaaactgtgtggcctaaaaatgattttgtaaatattagagatcggtgttgaacaacaacagacattatttaaagctaaagactaaattcacagaataggaccctaaagttgaagatacccagaagataatttcagctagttttgtcaaactctttgactgcaatccctagtattttacatagcatcccagtacatgcttatccatctgtacatctaattgaaacaaaagtttcacaaaacagtaggttccattactatgtggaatgcattctgattttcccattgctgattgcaaaccactaaatggattagactacccactaatgagttgcaggtgacaagtttgaaaaaacaatgctctcgggcaacctgacctgatgcgttaatttatgagattttattttttgtagacagactagattgtccaaatgagtattattactttaactactatagtgctgtgttacagttgtttcagtgattattgcatttttcaaaaccatttttaaaattctgtttgaaatagttggaataacctgaaaacatttaatatcctgttttggtaaattttcatctccaagattaaatttttttaaccagccaacagatgtttgaaggcaagttaggagatatgatggatactggatacagtatccatccatgtactagatacagtatccatccatgtactggatacagtcatactgttagcaaattttagatacataaagtaaaacaaacaaaatgcagtataaacagttaatattggaatctagtgttgattttatgattaatctcaatgaggttactgtatattcataattctataggtacacaaaaatatttggtaaaagatttatagttgagaaaatgctagacactaaagtttgttaacttacaatttaagaataagggctgggtgcagttgctcacgcctgtaatcccagcactttgagaggctgaggtgggcggatcatgaggtcaggagttcaagaccatcctggcaaacgtagtgaaaccccatctctactaaaaataaaaaatttagccaggcgtagtggcgcctgcctgtaatcccagctactcaggaggctgaggcaggagaattgcttgaacccaggaggcggaggttgcagtgagctgagatcgcgccactgcactccagcctaggcgacagagtgagatttcatgtcaaaaaaaaaaaaaaaaagagtaaggacatgagtaaggttatgtctcacctgtttttaaggaaatgtggatataagatgggttctagtccattaaaaggtggtaatttatactaagtcttactgtgagagaccataaactgctttagtattcagtgtatttttcttaattgaaatattttacttatgacttagtagatactaagacttaacccttgagtttctattctaataaaggactactaatgaacaattttgaggttagacctctactccattgtttttgctgaaatgatttagctgcttttccatgtcctgtgtagtccagacttaacacacaagtaataaaatcttaattaattgtatgttaatttcataacaaatcagtaaagttagctttttactatgctagtgtctgttttgtgtctgtctttttgattatctttaagactgaatctttgtcttcactggctttttatcagtttgctttctgtttccatttacatacaaaaagtcaaaaatttgtatttgtttcctaatcctactccttgtttttattttgtttttttcctgatactagcaatcatcttcttttcatgtttatcttttcaatcactagctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtaaatacattagtaatgtgattatggtgtcgtatcatcttttgagttagttatttgtttatcttactttgtaaatattttcagctatgaagagcagcaaaagaaggatttggtatggattacccagaatcacacatcatgactgaatttgtaggttttaggaactgatttgtatcactaatttattcaaattcttttatttcttagaaggaatattctaatgaaggaaattatctctttggtaaactgaattgaaagcactttagaatggtatattggaacagttggagggatttctttgctttttgttgtctaaaaccatcatcaaactcacggttttcctgacctgtgaacttcaaagaacaatggtttgaagagtattgagagactgtctcacaagtatgtcatgctcaaagttcagaaacactagctgatatcacattaattaggtttatttgctataagatttcttggggcttaatataggtagtgtttcccccaaactttttgaactccagaactctttttctgccctaacagaagagttgttattgaacacagtttgggaaaggctgatgggatttggaaatttgaaagtgaaggatcagaattttagttttttcccttttgtgataaagtagaacagggaaaagatgcagtcttttgggtagtctacttaacttcataattctgaactggttcagtttctactgtaaatataaccacttagtaactgagcttgcttacgtttaaaattgagtacatgacaattacaggaaaaggtttccactgaaggtaccatcagaattgtgaggagtgtgcatagaataatgtatgtcatttcccttcagctttgagatttgagctgttatagcctgttgattctaattgagttgacctttctgttactgttcttagtcacacacacacacacacacacacacacacacacacacacacacacgcatcccttatctataatctagctagtgttttattaataactaaaaagctatgccatttgtatgtagtttgttctaagtaaatcagagatacataagacgacgccctttttgagatagaaaattataaacttcataaagttcttaaatttggtaaaccttagctctagcttttgatgtatctagaaatgttaaaccttagctataaagcatacttgcattatatgcagaaatacttgtaagaaaaaacatagattaagcagttccagtaagataactgaagtgatggcagtagaagtatcaaaaaggagtattttaccaggaggttatggtgcttttctccctggaacatgagaaaatgtgcctaaaatggaacttcagagttatattctgattaacttatagcttgttgctcttggttccaaggaagggcatttgtgacattttattaaattcattaattttttagacacaccattgtcagcttgaacaaatttattaattgtaattatttgtcagctgttcttgatcctgttaataccatacttataactaaaagcatttccatggatgttgtaacttggcctgtaaaaaaaatgtttagatagaaaccatgaaactcaaatatgaattgtttaattttcaaaccattttgcattcagaaaatgtcctaagcttaattcatactcctagtgatcaaggaaacatgttaaagctccttatttttaaacttaaagtgacaatgacattttcaaagattttaaaattcttataaacaggttaaaatacttatatactgtataatttgatttctgatttctaagctctacttttctattggaaattacagatttttttcagacttaattcttaagatgttttcattgtttcacagtagcaactaaacatgtagtaaaatgatttaaattcaattaaaatttttttccttagtcatttaaaagggaagaaatcaatttttagtagtactcattccaaagattccaattttccttttttttaatcttttattttttggtggagggaggcaggatctggctctgaggcccaggctggagtgtagtggttctgtctcggctcactgcaacctccacctcccaggctgaagactcaaaccatccccatgcatcaccctctcaagtagctgagactataggcacatgctaccacacccagcttattttttgtgtttttgtagagatggggtttctccatcttgcccaggctggtcttgaactcctgagctcaagtgatctgcctgcctcagcctccccaaagtgctgggattacaggtgtgaactaccacaccgggccccaattttccaatgagtgatataaaaaaggcctccacgcaggcgcctgtagtcccaactactccggaggctgaggccagagaatggcatgaacccgggaggcggagcttgcactaagctgagtgctgctgcactccagcttgggcgacagagcgagaccgtctcaaaaaaaaaaaaaaaaaaaaaagcctccatgattggggcttgcatagtgaagaccatgtgaaattgaaagactacgaaactacttttcttttacgtattggcccataattaacatgtgtattgaatagctttgtttatctaagttcatcagatttatccaggtttatgtatttcagatcatctgattttattaggaaaatgctagaaaaatttcatggcaccattgtctaattttgaaaaaacgaacctttctttactgtgattaaaaattgttttttaggccaggtgtggtggctcacgcctgtaatcccagcactttgggaggctgaggctggcagatcacgaggtcaagaggttgagaccatcctggcaaacatggtgaaaccccttctctactaaaaatacaaaaattagctggcgtggtggtgcacacctgtagtcctagctactcaggaggctgaggcaggagaattgtttgaacctaggaggcagaggttgcagtgagctgagatcgtgccactccagcccaccctgggtaacagagcgagactccatctcaaggaaaaaaatgaaaaattgttttcaaaaatagtacgtgtggtacagatataagtaattatatttttataaatgaaacactttggaaatgtagccattttttgtttttttatgtttatttttcagctatgggtggataaagcatgaatataacttttcttatgtgttagtagaaaattagaaagcttgaatttaattaacgtatttttctacccgatgccaccaaattacttactactttattcctttggcttcataaaattacatatcaccattcaccccaatttatagcagatatatgtggacattgttttctcaagtgctaatataatagaaatcaatgttgcatgcctaattacatatattttaaatgttttatatgcataattattttaagtttatatttgtattattcatcagtccttaataaaatacaaaagtaatgtatttttaaaaatcatttcttataggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagtaagttctttgtcatttttttaattcagtctcttagattttatttaaatgcaaaaatttaatttatgtcaaaattttaaagtttttgtttagaatctttgttgatactcttatcaataagataaaaatgttttaatctgaccgaagtaccagaaacacttaaaaactcaaagggggacatttttatatattgctgtcagcacgaagcttttgtaagattgatttcatagagaagtgtttctaaacattttgtttgtgttttagtgaaatcttaagagataggtaaaaatcagagtagccctggctaagggtcttggtagttacaacgagtgtgcctgctcctaccacccccacccccaccttgagacaccacagaatttctcatagagcacagtgtgaattctattgctaaattggtggtatggggtttctcagcagagaatgggacatcacagtgactgacaatctttcttttataggttggaaactatttgggggactggagggatactgtctacactttttacaatttttattgataagatttttgttgtcttctaagaagagtgatataaattatttgttgtattttgtagttctatggtggcctcaatttaccatttctggttgctaggttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggtaataaatgtttttatgtcacattttgtctcttcattaacactttcaaagcatgtatgcttataatttttaaagaagtatctaatatagtctgtacaaaaaaaaaacaagtaactaagtttatgtaaatgctagagtccacttttctaaatcttggatataagttggtatgaaagcacacagttgggcactaaagccccttttagagaaagaggacatgaagcaggagatagttaatagctaagtgtggttgtagtataaagcaagaagcagggtgtttcttgtattaagctgtaagcaggaacctcatgattaaggtctttatcacagaacaaataaaaattacatttaatttacacatgtatatcctgtttgtgataaaaatacatttctgaaaagtatactttacgtcagatttgggtttctattgactaaaatgtgttcatcgggaatgggaataacccagaacataacaagcaaaaaattatgacaaatatatagtatacctttaagaaacatgtttatattgatataattttttgattaaatattatacacactaagggtacaaagcacattttccttttatgatttgatacagtagtttatgtgtcagtcagtacttccacatttttgctgaactggatacagtaggcagcttaccaaatattctatggtagaaaacttgggacttcctggtttgcttaaatcaaatatattgtactctcttaaaacggttggcatttataaatagatggatacatggtttaaatgtgtctgtttacatacctagttgagagaacctaaagaattttctgcgtctccagcatttatattcagttctgtttaatacattatcgaaattgacatttataagtatgacagttttgtgtatatggccttttcatagcttaatattggctgtaacagagaattgtgaaattgtaagaagtagttttctttgtaggtgtaaaattgaatttttaagaatattcttgacagttttatgtatatggccttttcatagcttaatattggctataacagagaattgtgaaattgttaagaagtaggtgtaaaattgaatttttaagaatattcttgaatgtttttttcttggaaaaattaaaaagctatgcagcccaataacttgtgttttgtttgcatagcatattataagaagttcttgtgattaatgttttctacaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccgggtaagaaagcaggtgtctgcaaaaagtcatgtatcgatttattgtttgtaatgatacagtagtatagcagataactaagacatattttcttgaatttgcagaatctagatttccaagcactagaagaaactacagaatatgacggtggctataccagggactctgttctgattaggtgaggtacttagttcttcagaggaagatttgattcaccaaaggggtgtgtgattttgcttcagacctttatctctaggtactaattcccaaataagcaaactcacaaattgtcatctatatacttagatttgtatttgtaatataatcaccatttttcagagctaatcttgtgatttatttcatgaatgaagtgttgttatatataagtctcatgtaatctcctgcatttggcgtatggattatctagtattcctcactggttagagtatgcttactgctggttagaagataattaaaataaggctaccatgtctgcaatttttcctttcttttgaactctgcatttgtgaactgttacatggcttcccaggatcaagcactttttgagtgaaatggtagtcttttatttaattcttaagataatatgtccagatacatactagtatttccattttacaccctaaaaaactaagccctgaattctcacagaaagatgtagaggttcccagttctatctgcttttaagcaaatgcccttactactctactgtctacttctgtgtactacatcatccaattctgaaagacataggcttccccatcccctgctaagactggttcaagtggcagctactgatggattgcagtgagaaggcatgcaaacacgtaccttcctggaagttgtctccaaaggctattgctctaagactcaagtatataaacactagaatgaatatcaactctatctagcaataaatgttatttttatattacagttgacccttgaacaacacagctgtgaacttcatgggccctctgacatgcagattttttttctcaactaagagcagattcagtattggtgggactcagaacctgcatatacagagggctgactttcatacatgccagtttcacagggccaactgcagaacttgagcgtgcatggattttggtatacacacgtggtcctggaaccaatccctgtcacatataccaagggatggctgtatgttactttatattcatttgttctgttattttataaggttgttcgtcgtggtatgtgggaattcaccagtatttcttctttctggtgcaccgttggtcatttctggcagcagtggtgaatgtatttactcttagcaacctctgtgctgctacctgttctgagtttcaaaggtgattcattaaagggttgggataacatggtgataggaaaaacccccctcatcagtcacaaggagtataacagcaatatctctgtaatatgattgatcatagatataatttctagtaggaaaaaaagtcatatcttgatgcatctctgagaatagttgaacatatcttgtgctattctttatagagaaattatctttgaaattaaagtcttaattttacttctagctttttataacaacataatccctacttggtatgtatcttaagatcatttttaaatgtatgatttgaagggcaaactagtgttatgtgaaaaatgacagataaagtagcttccaactcatcctcaagagttgatgatattctaaaccttttctaactaaattcagcttcttaattttctcaatataaatatgatgaaaatattaattcattaaatagtctacaagtattcggtagttgaagacttaaagtagtgcttgtaataacagaagagaaaaaagacattacaggcgtatctcactttattgcactttgcagatactgagtttttttggtggcaaccctgcatcaagcaggtctaccagcaccatttttccaacaaaatgtgctcacttcattagcatttttagcaatgattttaaattaagataatgtacttatttttagacaatgctgttacacacttgactacagtataatgtaaacgtaacttttataagcactgggaaacaaaaaaatttgtgtgactcactttactgccataatcactttatttgccatggtctgaaactgaaccggcagtatctctggggtatgcctgtatagatattttggttggtatttatttattgtatgcagaattcataaaaataaaaactgcgaggctgtttaatacatttcaactaaaagttgccagcatcattaatatgtaaaccactagaaataagattttgttaattttttgtttgtttgtttaaacagtcttgctctgtcactgaggctggagtgcagtggcgcagtctcagttcactgcaacctccgcttcctgggttcaagtgattctcctgcctcagcctcctgagtagctggggttacaggtgcacaccactacacctggctaatgtttgtatttttagtagagataagggttttgccatgttggccaggctggtctcaaactcctgacctctggtgatccgcccgcctcggcctcccaaagtgctgggattacaggcgtgagccaccatacctagcaaaatcaactctgaatctgaatcaaacctttgaaacaaaaattaccaatcaaaaaaacgtgcaatccctgctcctaactttgaaaaagtgacaaggaaggacatttggaaagatgtctctaagcagtcaacaagaaatgaaatcagggagagctttttcagcacctgaaaaaatacatgcaaaaacgcccgaggcgggcagatcaccggaagccaggagtttgagaccagcctggcaaacatgggggaaaccccgtctctactaaaaatacaaaaattagctgggtttggtggcaggcagctgtaatcccagctcctcgggaggctgaggcaggagaatcgcttgaacctgggaggcggaggttgcagtgagcctagatcgtgccactgcactccagcctgggcaacagagtgagattccatctcaaaaaaacgaaaaacagattcagagtttatttccttcccaaatacttcatagatgttggtttgtaggaataacttaaaagtctcactcgctttctgtcttttctagtaatttttatcgtggattctgattgcctagatctgctaattcattgagggttacaaaattgtgatactcgaattctttattcctccttcctttattacctgtaatacttcttaagaaaaactctttctcatcaactctatgactaccctaaattacagatccacatataggatctgtatacatgtatataaatatgtacatatcatatacgataatgcttaattctttcccattacttactaattttcaaaataatgtgattccctaactgctctctgaatgttatcaatgtggtggtaataatggtggtgtcgatgttgtgtggggtaaaatttgaatacagtgaaatacccagggcttaattgggttagtttttaaaaattacatttatgtaaccatatttcagtcaaggtgtagactatgtccatcagcacagagttcccatgttttcccttccagtgaatctccatcccccattagaacagacaataactgtcctaattactgtcactgtagcttacttttgtctgctctagaatttcttatgaatggaatcttatgtacttgtactgcatgaagactctttagattcatccatgttattgcattgatttatagtgccttttaaaaaattatagagtagtgttgcattatatgaatacgcaaagtgttttttttttacctgttggtggacagttggattgtttccagtttgggactattgtgaataaagctgtgtagtcttattgtggaaatgttttatttctcctgggcaaacatgtaggagtggagtttccaaagcatatagcaggtgcatatttaactaaaagtgtcttttcctcatttttaatattggatttttgtatttctattgactatagatattttcttaaaatatagcagtatgtcttatccttagttttgcttttttttggtttcagttatctttggtcagcagtggtccaaaaatatttattaagtagaaaattccatgaataattcagggtttttgatgtatgtgtgtgttggcgggtgcagggcagggagagttggttggttggttcgttggtttttttttttttaaagagacaaagtctctgtcatccaggctggagtgcagtagcatgactacagattgttataaactgaaactcctgggctcatgcaatcttcttacctcagtcctctgagtatctgggctcatgcaatcttcttacgtcagccctctgagtagctggtactacaggtgtgcagctaatttttagttggttatttttttgtagaaacagggtctcactatgttgcccaggctggtttcaaacccctggactctagcaattcttccacttcagccttccaaagtgctgggattacaggcgtgagccactgcacccagccaacaactcttaagttttaaattacatgctattctgagtaacatggtgaaatctcccacctttccacccagggcatgaattatccctttttccagtatatcgttgttgtctagactacccaccacttttagtctactggttatcagatcgactgttgcagtatcacatgcttgtgttcaagtaacccttattttacttaataatggccctaaagcacaagagcagtgatgttggaaattcgaatatatatgccaaagagaagctggaaagtgcttcctttaaggaaagaatttaaaaatcatatgttgaggttgctaaaatctatggtaaaaatgagtattgtatctatgaaattgtgaagaaggaaaaataaatcatgcatagtatatacagggttcagtactatttgcaatttcagacatcactggaggtcttggaacgtattccccatgggtaagtggggaatactgtatattctatataaaaggcccatttctgataagtagtttatgattattttctccaagttttcattttcttaagtgtcttctggtgagcagaaattattcattttttgaggtctaatttattttttcttttatggttttttatgtccttttatatctttgcctagcccaaagccacaaatatcttatgttttcttctaattgtgtaatataggtttaacttttatgtgtaaatctgtgatccaccaccaataaaattttgtgatgctgttagacagtggatgtcattcattttctaaatagttttatttatttgttccagtaccatttgttaaagagacttttctttccccattgaattgcctttgcacctttgttgaaaatcaatctgtgtgtgagccgtgtttctggattctccattctgttctattaatttgttttgtccttttgccaaaatgacactgttatggttactgcagcttcaaatcagatgctgtgagtcccacaactttttcattaggttgctttgacttttatttgcatataaatattagaatcagttaatttttacaaacaaaagggcaaagcctgcagagattttgatttgggttgccttgactggggcaggtcaatttggagagaattcacattttaacaatatattcttccaatccttgaacaccgtacgtctctccatttatttagatgtttgttagtttatctcagcactgttttatagtttttaatgttgaaatcatgtactctttggttaggaataaacttaaaatatgtttctaatgctattagtggtattttttaaatactgcttttcacttgtttattactatcttgaaataaaatcgatttttatatattgatcttatatcctataacctttctaaattgacttattctagtagttatttagtagatttcatagggttttctagtaaacagctatgtcatctacaaatcaagacaggtttctttctttccaatgtttatgttatttattactgttcctctattgcactggctagaacctttggtagaaggtattcttactttattcctcattttattgagagagactataatatttaccattaactgtgatgttacttgtaaacaaaaagtttgtatttctctgggattaaaaaccaagagtccatttggttttttactgttgagttttaagggttccttatgtattttctaggtatgttcttccttcattgaattgtttttttcacatacgttaaaaatcacttgagaatatttatataggtctgcttctgagatttatctgtttatcaggttttgtttcatttattttgaggctctatcatttggttcatacccatttagaattactatgtcttggtgattggtcctttatcattatataagttttttctgttttgcgattttctttgctctgaatctgatatgagtgtaaccatttgtttttttttaaattaatgtttgcatgatctgtcttttactatcattttactttcatcctgtgttgctgaatttgaaacgaatctcttgtaaacagcatatagttgtcattttaataaaaactgttagtctctgccttttaatttttttatttagaccatttatatttaaggtaattattgatatgttagggagaggtctgccattttattatttgttttctgtttctgtcttctgtttatggttatttatttattgccttccatgattacttgaacattttttaagatttttaagacccttgatttatttagtgtttgggttttgttttgtttgtttgtttgtttttgtttcgagacacagtctcgctctgttgcccaggctggagtgcagtggcacaatctcagctcactgcaacatcggcttcccaggttcaagcaatcctcccgcctcagcctcctgggtagctgggactacaggcacatgccaccacacctggctaatttttgtatttttattagagatgaggtttcaccatattggccaggctggtctcgaactcttgaccttgtgatctgtccacctcagcctcccaaagtgctggaattacaggcatgagccaccatgcctggccttctatgtgttttttatagttgttttcacggtcattgtgggtatcacattatagataatgtgacttaccaccattcactgccatcaataccattacatggaatgagatatggaaaccttaatttcagttgggtctctttccccacttttaaatagtattgttttgaggattaatgctattacagtttttgtatcagttatccaatatgacttatagaacttatcaagggagtgatgctctgttgtatgtacccatgtttctgctatttccattattttttccaagattccatcttttattacttccattagccagtcttcaaaggcagttctgctagtgagaaattctttttgtttttctctttctgaagatgactttattttccctttattcccaaagaatagttttatttgtgctatttggggttcgctcagcttcttgaagctgtaagtttgtgtcttttgccaaacatggaaaattttcaaccattatttcttcaggtgttctttcagcgtcactcttttctccattctaggcctctaatgatacaaatgttgagtcatttgttactgttccacatggacctgaggcatggttcatttttcagtctattttctctcttttgttcagatttctctcctttgtcatcttcactctactgttgagcccatctaatgattatttttctcctattgtattttttaggtctataatttccatttgcttttttttccttgtatcttgtttccttgctgagattttctattgtttcgtttttgaaacagtagaacttgtaattgcttgtcaaatcatttctctgatggcagcattaagatccttgccagataatttcagcatcttactcatcccagtgttggcgttttctttccttcatgtaattttcctggttcttggtatgacagataatttttggattgtgtctcggacattttagttattatatcaggagactctgtactttttaaaaattttaacttcagtagtaacctgttaaggtatagcatgtaggtactagcatatatttgtgagctgtggttccagtgaccatttttcagaggctttatggtgctgttttggtttgttgcttttatctcagtccactggggctcgcactggttcctagtagtgctgcttgaggggccttctccaggctgagctgcgcagagtgtgtttgggtgagggaagaggacccccactagattttcgtgggctggagagtgcttcctgagccttgtgcctgttgtggcaggctcccccttgctggtgttcctggcagtgctcctgaccacattgtgtccctgggctgtggaacacttgcaggaaaggtgaacactgccaggaccaattatagcagaattcctcctgccagtacacagcagcactgtggctctggaccagcaaggagagtctcaagcatgggtttgtttctttttgattttaagatttttcttctgccttcaggttctggtattattgttctgttttattcacctttatgtttcttctagtttagttttagtttctttgtatttgatgggatttttttccttgcatttctaattactccttagttgtgtcatgtcttcctttttttcagttaccctcattcagaaatttcccatttctaatgatttgttattttttaaattctttttagctcagtttgaaatttgtttacagttttcatgttttatttgcatattgtttcatgtactttgattttctgtagggacaccattctcatgtatatgcacatactttttctctaataattacactgtttcactctgttctgttatttatttatttgtgtgtgtgtgtgtgtgtgtgtgagtgaaatgagtttctcatacttggacgagggagagatgggccaggataacttttttcgctttttagggacgaggagaagtctgtgtttttgtaaaatggtcaaaaatatgcccttgtgctttctgaaactgccttctttactcctctatcccacacatatatttgaacttttttttggtttttattactgacctggtccattcggaagttattcccagaagtttttcctcggtacaaggtttgtttctggtgggggtttggtattcgggtgttttaagggcccagagcttactacatcatgatccctttgtaatcatctgcaaattagatcctgtagaactttttaaaactttaagccctgttttcagattggcctgtgctttccagtgggttggcagtgttctcagggctgtcagaaacccagtcagttaccttgcatctgcttccttactaaccagtcttgtagttgtcagagctttgtttctgtccaattatatgcaatggttcatggttttgttgtagataatgtctctgggtctttggttttctcattcagtttgctgtttttgtaggggaggttgggagggaataaaacaaaaaataataataataataactatgtcgttgccatcatcatctttccagaacctgctacctgcccttcacctgattttcgtatttatcagtatcattaccttaatctgttatctcattggggattgcaaaatggctgtttggggaaaaaaaatttccatctgcttgtcctacatatatacctggcattcttttttctcatcattgggtgccatttgattaccttgaaaaacagttctacagaaaaggcatgataaaatagatttaaggtttttagagtaaggagttaatgtaataattttaatagtgacaatttaattttgttttttggttggtttttgctgcctttttgaatattacgaactaatgaatgtttttgtatttaatacgtttcacagtcattactctaaatgatattcaaattgcttagctatcgtgtgcttttaaaatgaccctattagattttgagatttctaactaatctcgaacattcattctcaggcctggaataagttatttttccaataaattgttggagaatggcatttagaagtcagattttagatgcaaagtatggcctttgcttttgaacgttactgcttgtaggccttatcagaggacagaactaggaaaataatcttcctagtgtatcctgagaatcatcccacattattgcagaggtgttttccattttgttttgtatgactgaatactgctcctttgtgtggatgcagcatagcttatcaatatttatgggcatcgaggttatttttaaccttttgctgttagtactaatgtcacagtgaatcctcttaatgttcatgcattattccgtacatatgtaaagtatcattaagataaattgttagaagtgggattgttgcatcaaatggtagatgcatgtgtaattttgctagatactgccaaatcctccttcacagaaaaataacattttgcattcccaccagcagtttacaacagtatctcttttcttaaaactttccaaacagaatgtgttgttaaatgtggatgtttacttatttgccaattgagaaatggtattttactatagttacaatttttgagcttacctcaattatgaatgataatggacattttttcttgtagagctgtttatagttttatatagtcttttgctcattttgctgctcagctggtcgttttcttcacttttagaaactttatatgttaaggagattagtcctttaacgctggtaaattcgcaaatattttttcccagtttgtcatttgtcttttaaccttgcttataggatttttttgccaaatgaaaggttttatgtttatgtagttagctattaatctttttcgttattatgctttgatatgcatttctttagttatgtttattttattcattttctttgttttttaattttctagagtctgtcctcagtagaaattttagtcatactgcttcttctttggtcaccttataataaaattagcctttatttccaaagttaccttgcatatttcttcagtattttttagtattcttatttttatttaagatgtgctcatttctttctgaatttgtatttctcatcactggtggtctgtcttgtctgctgctgcattctccttttgtgttggaatgtggtgttactagtttcccattgtttatgactgaatttttctggtctacttttgtctaccggaaagttttgcttctcattcgccagactcttcccataataactttatttagacttccgaattctgtttttcttgtttatgtttctataacagatgttacttttttctggacctgttattactagacctcatggtggagcagggaggaattgtgtggctttaggggtcttggttgaagggatccctcttctgttgctttagtaagggcagaatcaccactttctgatttttcagctccatgtagcttaatgaagactctttttcattagctgcttccacccctttacagccgcttaagggacacttctgcttttgaaggtaccccccttcctttcatgcatggtgccttcctgagcctgccattgctggacccaagtacttttctgtagtccttcctttaaccaccctgttgccagtgctctaacctacactcagtagtgctctgttgaggggcaggtggtggagggggtggggtctggccttgggtgatccctaatcagtatgattccgcacaagccactcttcgatgtagctcctgctggaccctgctcatttccccacttctttggtatttggagtttattgttctgtctcctagttttactctagacctaagtcataggttttttttttattttcccctttttgatccgggtagatttttagagatgtgagtaggatgtgatcgatacagccaccacttttatgtggaaacctggaagcttcttcgtgttttcttcagctttctaaatatatgcattcttgtttaattcaaaatgttaatgtaacacacataacacttataggaatagagatgcattttgttccctgttttcattgtataaaatttttaaaggtttcgtttaaaagtccaaagaaacagctccgtaataatatagccagactggtcattgtgaccactgctgatctgccacttcctgcagggtctgtctctgttcttcggtggtgctctttggtctacctccttaggtgtagctggttcagttaagcttcagagccctcctgcagtgtgaggaggctttattaccacccactgcagggcagcttttctgctatgttggagggttctgtgctacagcagacttgttttctcttgtcagcctccccaaaaggagtatcatgaactggggtccgattcctctcctccttacctgagagatgctcctgcaagtttcatgtccagttttctgttgttgtgtgtttcttttttgttttctcttgctgactggtggatttgtaaaggggcagggaagggaagtggcaagagattggagaaagccaagaattctaataaaacttttaagttatttcagataaatggtgttgcagcaccaaaaatgccagcattttggtaataaaaatagtatgttgggatattagaatatcaaaaggtagaaaattgtaattactggtttgggatgtgtgatgttctctgctaacattctggaattttttttttttttttttttgagatgaaatttttttttttttttgagatggctcaaaatgtttcccaggctagagtgcaatggtgtgatctcagctcattgcagcctccgcctcccatgttcaagcaattcttctgccttggcctcccaagtagctgagattacaggcatctgccaccacgcccggctaatttttgtattttagtagagacagggtttcaccacgttggtcaggctgatcttgaacccctgacctcaggtgatccactggcctcagcctcccaaagtgctgggattacaggcatgagccaccacacctggctctggaaagaactttctaaataactattaaaatgcattttatattatataagcaactaaaaatacttttaattttttttttaattttttaatcttaacattatttagctataggccaggcgcggtggctcatgcctgcaatcccagcactttgggaggccaaggtgggcggatcacgaggtcaggagatcgagacccatcctggctaacatggtgaaatcctgcctctacttaaacgtacagaaaattagccaggcgtggtggcaggcacctatagtcccagccacttgggaggctgaggcaggacaatggcgcgaacccaggaggcggagcttgcaatgagccgagatcgcgccactgcactccagcctgagcgacagagcaagactctgtctcaaaaaaaaaaaaatttatttagctatgaactagtgtatatatgttttatagatgcctgattattcaaataaacttcaagattgcactttatgagcttgtatttcgttttttagaactcaaactaacataagtgtcattaaaacatagcttttattacatagattttaggaatgccacaggataaatcattctcttaaaataactgcaggtggcagaaatgtcagaataattctcctcctccatacacagcacatattacttgtttaaagtattctagttcatataaaaattgaacttttgtattactgctattaggtatgtagttgtttgcatttggggccagttggttggggcagggggtctttttttcttttgtccttaatctgtatcactttttcctcccaaagttgagttaaaggatgagtagaccaggagaataaaggagaaaggataaataaaatatatacccaaaggcacctggagttaatttttccaaatattcatttcagtctttttcaattcataggattttgtcttttgctcattactgactgcataatgtgattataccatagtttaaatagtcacttcctgttactacacacttgggttttctcaattttttactattgtagtactaatattttactatattgtaatctaatctaaatttttacgtattcagagctgttcaggataaatttgcttggaaatttttaaatcaccagaagtgatactatcctgataattaacttccaagttgtctcttaatatagttttaatgcaaatcataagcttatgttagtaccagtcataatgaatgccaaactgaaaccagtattgtattttttctcattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggtaggtaattattaacttgtgactgtatacctaccgaaaaccttgcattcctcgtcacatacatatgaactgtctttatagtttctgagcacattcgtgattttatatacaaatccccaaatcatattagacaattgagaaaatactttgctgtcattgtgtgaggaaacttttaagaaattgccctagttaaaaattattatggggctcacattggtttggaatcaaattagtgtgattcatttacttttttgattcccagcttgttaattgaaagccatataacatgatcatctatttagaatggttacattgaggctcggaagattatcatttgattgtgctagaatcctgttatcaaatcattttcttagtcatattgccagcagtgtttctaataagcatttaagagcacacactttgcagtcttgtaaaacaggtttgagtattttctccaccttagaggaagttacttgacttctcagtgacctaacctctaaagtgcatttactgatgtcctctctgtggttttgttgtggaaagatttagttaaatgaactgtaagaattcagtacctaaaatggtatctgttatgtagtaaaaactcaatggatacagtatcttatcatcgtcactagctttgagtaatttataggataaaggcaacttggtagttacacaacaaaaagtttatgatttgcattaatgtatagtttgcattgcagaccgtctcaactatatacaatctaaaaataggagcatttaattctaagtgtatttcccatgacttacagttttcctgtttttttccccttttctctatttaggttacctacatctcatacttgctttaatgtgcttttacttccggaatactcaagcaaagaaaaacttaaagagagattgttgaaggccatcacgtatgccaaaggatttggcatgctgtaaaacaaaacaaaacaaaataaaacaaaaaaaaggaaggaaaaaaaaagaaaaaatttaaaaaattttaaaaatataacgagggataaatttttggtggtgatagtgtcccagtacaaaaaggctgtaagatagtcaaccacagtagtcacctatgtctgtgcctcccttctttattggggacatgtgggctggaacagcagatttcagctacatatatgaacaaatcctttattattattataattatttttttgcgtgaaagtgttacatattctttcacttgtatgtacagagaggtttttctgaatatttattttaagggttaaatcacttttgcttgtgtttattactgcttgaggttgagccttttgagtatttaaaaaatatataccaacagaactactctcccaaggaaaatattgccaccatttgtagaccacgtaaccttcaagtatgtgctacttttttgtccctgtatctaactcaaatcaggaactgtattttttttaatgatttgcttttgaaacttgaagtcttgaaaacagtgtgatgcaattactgctgttctagcccccaaagagttttctgtgcaaaatcttgagaatcaatcaataaagaaagatggaaggaagggagaaattggaatgttttaactgcagccctcagaactttagtaacagcacaacaaattaaaaacaaaaacaactcatgccacagtatgtcgtcttcatgtgtcttgcaatgaactgtttcagtagccaatcctctttcttagtatatgaaaggacagggatttttgttcttgttgttctcgttgttgttttaagtttactggggaaagtgcatttggccaaatgaaatggtagtcaagcctattgcaacaaagttaggaagtttgttgtttgtttattataaacaaaaagcatgtgaaagtgcacttaagatagagtttttattaattacttacttattacctagattttaaatagacaatccaaagtctccccttcgtgttgccatcatcttgttgaatcagccattttatcgaggcacgtgatcagtgttgcaacataatgaaaaagatggctactgtgccttgtgttacttaatcatacagtaagctgacctggaaatgaatgaaactattactcctaagaattacattgtatagccccacagattaaatttaattaattaattcaaaacatgttaaacgttactttcatgtactatggaaaagtacaagtaggtttacattactgatttccagaagtaagtagtttcccctttcctagtcttctgtgtatgtgatgttgttaatttcttttattgcattataaaataaaaggattatgtatttttaactaaggtgagacattgatatatccttttgctacaagctatagctaatgtgctgagcttgtgccttggtgattgattgattgattgactgattgttttaactgattactgtagatcaacctgatgatttgtttgtttgaaattggcaggaaaaatgcagctttcaaatcattggggggagaaaaaggatgtctttcaggattattttaattaatttttttcataattgagacagaactgtttgttatgtaccataatgctaaataaaactgtggcacttttcaccataatttaatttagtggaaaaagaagacaatgctttccatattgtgataaggtaacatggggtttttctgggccagcctttagaacactgttagggtacatacgctaccttgatgaaagggaccttcgtgcaactgtagtcatcttaaaggcttctcatccactgtgcttcttaatgtgtaattaaagtgaggagaaattaaatactctgagggcgttttatataataaattcgtgaaga

SEQ ID NO: 7 - DNA, 20 bp, Artificial Sequence
  Synthetic oligonucleotide
gttatacacacatatatttt

SEQ ID NO: 8 - DNA, 20 bp, Artificial Sequence
  Synthetic oligonucleotide
tagcttaaacacactttttc

SEQ ID NO: 9 - DNA, 20 bp, Artificial Sequence
  Synthetic oligonucleotide
atatgttggtcagctactac

SEQ ID NO: 10 - DNA, 20 bp, Artificial Sequence
  Synthetic oligonucleotide
gtatatccttccagatcctt

SEQ ID NO: 11 - DNA, 20 bp, Artificial Sequence
  Synthetic oligonucleotide
tgagttcattggcacattca

SEQ ID NO: 12 - DNA, 20 bp, Artificial Sequence
  Synthetic oligonucleotide
ctagaaggtgatatgaggat

SEQ ID NO: 13 - DNA, 20 bp, Artificial Sequence
  Synthetic oligonucleotide
ataaatatttctgcatattg

SEQ ID NO: 14 - DNA, 20 bp, Artificial Sequence
  Synthetic oligonucleotide
catgtacatccctatacctg

SEQ ID NO: 15 - DNA, 20 bp, Artificial Sequence
  Synthetic oligonucleotide
gacacttttcttgcataaat

SEQ ID NO: 16 - DNA, 20 bp, Artificial Sequence
  Synthetic oligonucleotide
gtcaaaatagttattttggg

SEQ ID NO: 17 - DNA, 20 bp, Artificial Sequence
  Synthetic oligonucleotide
aaaatttttatctcagctac

SEQ ID NO: 18 - DNA, 20 bp, Artificial Sequence
  Synthetic oligonucleotide
taagaagtaagcaactaggg

SEQ ID NO: 19 - DNA, 20 bp, Artificial Sequence
  Synthetic oligonucleotide
agcacatgcaatgattagat

SEQ ID NO: 20 - DNA, 20 bp, Artificial Sequence
  Synthetic oligonucleotide
acaatatatattttgaaact

SEQ ID NO: 21 - DNA, 20 bp, Artificial Sequence
  Synthetic oligonucleotide
caagatggagaattcttggc

SEQ ID NO: 22 - DNA, 20 bp, Artificial Sequence
  Synthetic oligonucleotide
tgaatatgcttgacccatag

SEQ ID NO: 23 - DNA, 20 bp, Artificial Sequence
  Synthetic oligonucleotide
ttcctttgtgtaaatgtacc

SEQ ID NO: 24 - DNA, 20 bp, Artificial Sequence
  Synthetic oligonucleotide
tcaagcatacttgggccttc

SEQ ID NO: 25 - DNA, 20 bp, Artificial Sequence
  Synthetic oligonucleotide
aacacctggcagctgcatac

SEQ ID NO: 26 - DNA, 20 bp, Artificial Sequence
  Synthetic oligonucleotide
tgttagtgtccctatccgtc

SEQ ID NO: 27 - DNA, 20 bp, Artificial Sequence
  Synthetic oligonucleotide
ctgcaagaacagcatagcat

SEQ ID NO: 28 - DNA, 20 bp, Artificial Sequence
  Synthetic oligonucleotide
caaaggtccaggttagttga

SEQ ID NO: 29 - DNA, 20 bp, Artificial Sequence
  Synthetic oligonucleotide
tttcaggccccaccctcggg

SEQ ID NO: 30 - DNA, 20 bp, Artificial Sequence
  Synthetic oligonucleotide
aggtccaacatctttctttc

SEQ ID NO: 31 - DNA, 20 bp, Artificial Sequence
  Synthetic oligonucleotide
aatatgctggtcaagccttc

SEQ ID NO: 32 - DNA, 20 bp, Artificial Sequence
  Synthetic oligonucleotide
aatgcagtttgctatggctc

SEQ ID NO: 33 - DNA, 20 bp, Artificial Sequence
  Synthetic oligonucleotide
ggttgtgagcaaccatgtgg

SEQ ID NO: 34 - DNA, 20 bp, Artificial Sequence
  Synthetic oligonucleotide
attatatgattgcatttgaa

SEQ ID NO: 35 - DNA, 20 bp, Artificial Sequence
  Synthetic oligonucleotide
catagatgttaaattgttaa

SEQ ID NO: 36 - DNA, 20 bp, Artificial Sequence
  Synthetic oligonucleotide
atgtgatcttttaagatgta

SEQ ID NO: 37 - DNA, 20 bp, Artificial Sequence
  Synthetic oligonucleotide
catgaacagttattcattat

SEQ ID NO: 38 - DNA, 20 bp, Artificial Sequence
  Synthetic oligonucleotide
gctattttcctaggagcatt

SEQ ID NO: 39 - DNA, 20 bp, Artificial Sequence
  Synthetic oligonucleotide
gaagtgttttaaggttttca

SEQ ID NO: 40 - DNA, 20 bp, Artificial Sequence
  Synthetic oligonucleotide
aacccagtaatactgagcgc

SEQ ID NO: 41 - DNA, 20 bp, Artificial Sequence
  Synthetic oligonucleotide
tggatcctcaggtgcgactc

SEQ ID NO: 42 - DNA, 20 bp, Artificial Sequence
  Synthetic oligonucleotide
gtactggttaattaatattg

SEQ ID NO: 43 - DNA, 20 bp, Artificial Sequence
  Synthetic oligonucleotide
atttcaagtgttatcccctt

SEQ ID NO: 44 - DNA, 20 bp, Artificial Sequence
  Synthetic oligonucleotide
tattgaaaatgtgaatcact

SEQ ID NO: 45 - DNA, 20 bp, Artificial Sequence
  Synthetic oligonucleotide
gttttatcagaatggctcta

SEQ ID NO: 46 - DNA, 20 bp, Artificial Sequence
  Synthetic oligonucleotide
caccatttattaaagatgtt

SEQ ID NO: 47 - DNA, 20 bp, Artificial Sequence
  Synthetic oligonucleotide
cctgcagaggtatctgaacc

SEQ ID NO: 48 - DNA, 20 bp, Artificial Sequence
  Synthetic oligonucleotide
ttaaataaagcctttattaa

SEQ ID NO: 49 - DNA, 20 bp, Artificial Sequence
  Synthetic oligonucleotide
tgaaacagctgagcaatctc

SEQ ID NO: 50 - DNA, 20 bp, Artificial Sequence
  Synthetic oligonucleotide
tttaaccacaattgttctgg

SEQ ID NO: 51 - DNA, 20 bp, Artificial Sequence
  Synthetic oligonucleotide
tagaggtagcctttctgatg

SEQ ID NO: 52 - DNA, 20 bp, Artificial Sequence
  Synthetic oligonucleotide
agtcccagagatcctacctg

SEQ ID NO: 53 - DNA, 20 bp, Artificial Sequence
  Synthetic oligonucleotide
gtgtgtgcaaatggaggcta

SEQ ID NO: 54 - DNA, 20 bp, Artificial Sequence
  Synthetic oligonucleotide
atggtagttgtaattttcgg

SEQ ID NO: 55 - DNA, 20 bp, Artificial Sequence
  Synthetic oligonucleotide
aaatgtgatcattttactct

SEQ ID NO: 56 - DNA, 20 bp, Artificial Sequence
  Synthetic oligonucleotide
gttctactttaatcacattc

SEQ ID NO: 57 - DNA, 20 bp, Artificial Sequence
  Synthetic oligonucleotide
gtagttgtcttcagacaaat

SEQ ID NO: 58 - DNA, 20 bp, Artificial Sequence
  Synthetic oligonucleotide
tgtttacatccccaaatctg

SEQ ID NO: 59 - DNA, 20 bp, Artificial Sequence
  Synthetic oligonucleotide
gtgtaatgtgtggctgactt

SEQ ID NO: 60 - DNA, 20 bp, Artificial Sequence
  Synthetic oligonucleotide
gtgtatatgctagcttgtgc

SEQ ID NO: 61 - DNA, 20 bp, Artificial Sequence
  Synthetic oligonucleotide
tacccattccttgatcaatt

SEQ ID NO: 62 - DNA, 20 bp, Artificial Sequence
  Synthetic oligonucleotide
tgtagataaagaaattatct

SEQ ID NO: 63 - DNA, 20 bp, Artificial Sequence
  Synthetic oligonucleotide
agccaacattgtttaaccag

SEQ ID NO: 64 - DNA, 20 bp, Artificial Sequence
  Synthetic oligonucleotide
ttgccaggcttgtgccagat

SEQ ID NO: 65 - DNA, 20 bp, Artificial Sequence
  Synthetic oligonucleotide
aataatatctacttgtgtcc

SEQ ID NO: 66 - DNA, 20 bp, Artificial Sequence
  Synthetic oligonucleotide
atccaatttctagttgaatc

SEQ ID NO: 67 - DNA, 20 bp, Artificial Sequence
  Synthetic oligonucleotide
tacttaagtgatgtcactga

SEQ ID NO: 68 - DNA, 20 bp, Artificial Sequence
  Synthetic oligonucleotide
taatcttgtgatatggtatg

SEQ ID NO: 69 - DNA, 20 bp, Artificial Sequence
  Synthetic oligonucleotide
gagtgaaaatcagtctaact

SEQ ID NO: 70 - DNA, 20 bp, Artificial Sequence
  Synthetic oligonucleotide
gagattttaggatgtgtttc

SEQ ID NO: 71 - DNA, 20 bp, Artificial Sequence
  Synthetic oligonucleotide
acactactttagagtgcaca

SEQ ID NO: 72 - DNA, 20 bp, Artificial Sequence
  Synthetic oligonucleotide
attctttaaaatgtgaactg

SEQ ID NO: 73 - DNA, 20 bp, Artificial Sequence
  Synthetic oligonucleotide
atatcatcaaggaaaatgtt

SEQ ID NO: 74 - DNA, 20 bp, Artificial Sequence
  Synthetic oligonucleotide
attaaatcctaggtttgctc

SEQ ID NO: 75 - DNA, 20 bp, Artificial Sequence
  Synthetic oligonucleotide
ctgccaaccaagaattacta

SEQ ID NO: 76 - DNA, 20 bp, Artificial Sequence
  Synthetic oligonucleotide
aagacatggctacagacaac

SEQ ID NO: 77 - DNA, 20 bp, Artificial Sequence
  Synthetic oligonucleotide
gaggaaacagttgttatgac

SEQ ID NO: 78 - DNA, 20 bp, Artificial Sequence
  Synthetic oligonucleotide
cagcacccaaggagctgaag

SEQ ID NO: 79 - DNA, 20 bp, Artificial Sequence
  Synthetic oligonucleotide
tttaagaggctgaagaatta

SEQ ID NO: 80 - DNA, 20 bp, Artificial Sequence
  Synthetic oligonucleotide
ggaagtttgtggcattggtg

SEQ ID NO: 81 - DNA, 20 bp, Artificial Sequence
  Synthetic oligonucleotide
tgattgaggattcaaaacaa

SEQ ID NO: 82 - DNA, 20 bp, Artificial Sequence
  Synthetic oligonucleotide
ttattacaagggtcaaaaga

SEQ ID NO: 83 - DNA, 20 bp, Artificial Sequence
  Synthetic oligonucleotide
gtgctagccagtgtagagtt

SEQ ID NO: 84 - DNA, 20 bp, Artificial Sequence
  Synthetic oligonucleotide
tgccagatggaattggtctg

SEQ ID NO: 85 - DNA, 20 bp, Artificial Sequence
  Synthetic oligonucleotide
ctagtgaatgaattggataa

SEQ ID NO: 86 - DNA, 20 bp, Artificial Sequence
  Synthetic oligonucleotide
caaacaaaagctttccacat

SEQ ID NO: 87 - DNA, 20 bp, Artificial Sequence
  Synthetic oligonucleotide
caaagatgaaatatattggt

SEQ ID NO: 88 - DNA, 20 bp, Artificial Sequence
  Synthetic oligonucleotide
cgagtccaacaatgaaccaa

SEQ ID NO: 89 - DNA, 20 bp, Artificial Sequence
  Synthetic oligonucleotide
ctcaatcttcacaaaatgtt

SEQ ID NO: 90 - DNA, 20 bp, Artificial Sequence
  Synthetic oligonucleotide
attaaaattaaactgatctc

SEQ ID NO: 91 - DNA, 20 bp, Artificial Sequence
  Synthetic oligonucleotide
gtagacaatagttcgaataa

SEQ ID NO: 92 - DNA, 20 bp, Artificial Sequence
  Synthetic oligonucleotide
accctacctcaacaaagagc

SEQ ID NO: 93 - DNA, 20 bp, Artificial Sequence
  Synthetic oligonucleotide
aacaaggaatattatgtggg

SEQ ID NO: 94 - DNA, 20 bp, Artificial Sequence
  Synthetic oligonucleotide
tttacatatacgagcaataa

SEQ ID NO: 95 - DNA, 20 bp, Artificial Sequence
  Synthetic oligonucleotide
acgagccaaaatgtgacatt

SEQ ID NO: 96 - DNA, 20 bp, Artificial Sequence
  Synthetic oligonucleotide
tgttggaacttgaattacta

SEQ ID NO: 97 - DNA, 20 bp, Artificial Sequence
  Synthetic oligonucleotide
gtgatcctaagtactgaatc

SEQ ID NO: 98 - DNA, 20 bp, Artificial Sequence
  Synthetic oligonucleotide
gaagcctcttgcaattaatc

SEQ ID NO: 99 - DNA, 20 bp, Artificial Sequence
  Synthetic oligonucleotide
aaggaacaatttcgactcag

SEQ ID NO: 100 - DNA, 20 bp, Artificial Sequence
  Synthetic oligonucleotide
ttttgagaaatcactactac

SEQ ID NO: 101 - DNA, 20 bp, Artificial Sequence
  Synthetic oligonucleotide
aatgattggatagcttgttt

SEQ ID NO: 102 - DNA, 20 bp, Artificial Sequence
  Synthetic oligonucleotide
ctggaaaaagtgcaattttt

SEQ ID NO: 103 - DNA, 20 bp, Artificial Sequence
  Synthetic oligonucleotide
caacagtgaaatgacaattt

SEQ ID NO: 104 - DNA, 20 bp, Artificial Sequence
  Synthetic oligonucleotide
ggaagaatctagaacctttc

SEQ ID NO: 105 - DNA, 20 bp, Artificial Sequence
  Synthetic oligonucleotide
tgctcaatttaaataaaagc

SEQ ID NO: 106 - DNA, 20 bp, Artificial Sequence
  Synthetic oligonucleotide
gagacagtgattctcataca

SEQ ID NO: 107 - DNA, 20 bp, Artificial Sequence
  Synthetic oligonucleotide
tgtggctttagaataagctg

SEQ ID NO: 108 - DNA, 20 bp, Artificial Sequence
  Synthetic oligonucleotide
gcatgtgtaaatcaaagctc

SEQ ID NO: 109 - DNA, 20 bp, Artificial Sequence
  Synthetic oligonucleotide
acactggtactataattttt

SEQ ID NO: 110 - DNA, 20 bp, Artificial Sequence
  Synthetic oligonucleotide
gtcttttaactattaataaa

SEQ ID NO: 111 - DNA, 20 bp, Artificial Sequence
  Synthetic oligonucleotide
ccccgaaaatttctgccact

SEQ ID NO: 112 - DNA, 20 bp, Artificial Sequence
  Synthetic oligonucleotide
actatgtgtgtgcacgcacg

SEQ ID NO: 113 - DNA, 20 bp, Artificial Sequence
  Synthetic oligonucleotide
ggtatgaactcagttttctt

SEQ ID NO: 114 - DNA, 20 bp, Artificial Sequence
  Synthetic oligonucleotide
tgtttctacataaccaactc

SEQ ID NO: 115 - DNA, 20 bp, Artificial Sequence
  Synthetic oligonucleotide
aaatccatcatgtttttata

SEQ ID NO: 116 - DNA, 20 bp, Artificial Sequence
  Synthetic oligonucleotide
gtgtatgaagactcatcctg

SEQ ID NO: 117 - DNA, 20 bp, Artificial Sequence
  Synthetic oligonucleotide
ggagtggtttcaacttttct

SEQ ID NO: 118 - DNA, 20 bp, Artificial Sequence
  Synthetic oligonucleotide
gtttccaaaactcttgcatc

SEQ ID NO: 119 - DNA, 20 bp, Artificial Sequence
  Synthetic oligonucleotide
tgagctacatccctatcccc

SEQ ID NO: 120 - DNA, 20 bp, Artificial Sequence
  Synthetic oligonucleotide
ataattgaaatattaactct

SEQ ID NO: 121 - DNA, 20 bp, Artificial Sequence
  Synthetic oligonucleotide
accatacaatgagcagactg

SEQ ID NO: 122 - DNA, 20 bp, Artificial Sequence
  Synthetic oligonucleotide
aattactatcctttgagagg

SEQ ID NO: 123 - DNA, 20 bp, Artificial Sequence
  Synthetic oligonucleotide
taagtcacattctttgtgta

SEQ ID NO: 124 - DNA, 20 bp, Artificial Sequence
  Synthetic oligonucleotide
gattgttgctatagttgcag

SEQ ID NO: 125 - DNA, 20 bp, Artificial Sequence
  Synthetic oligonucleotide
ttgggttgagataagtagct

SEQ ID NO: 126 - DNA, 20 bp, Artificial Sequence
  Synthetic oligonucleotide
gtttaaaatgaacgacttgt

SEQ ID NO: 127 - DNA, 20 bp, Artificial Sequence
  Synthetic oligonucleotide
taggaggacctgagcaggag

SEQ ID NO: 128 - DNA, 20 bp, Artificial Sequence
  Synthetic oligonucleotide
ccaagaaggtaaattctgaa

SEQ ID NO: 129 - DNA, 20 bp, Artificial Sequence
  Synthetic oligonucleotide
gccatacatatatcattatt

SEQ ID NO: 130 - DNA, 20 bp, Artificial Sequence
  Synthetic oligonucleotide
ttgaaataatatactttgaa

SEQ ID NO: 131 - DNA, 20 bp, Artificial Sequence
  Synthetic oligonucleotide
attgaagtggcaagagtgta

SEQ ID NO: 132 - DNA, 20 bp, Artificial Sequence
  Synthetic oligonucleotide
tgtattaaccttatatactg

SEQ ID NO: 133 - DNA, 20 bp, Artificial Sequence
  Synthetic oligonucleotide
catcaagataattttacctg

SEQ ID NO: 134 - DNA, 20 bp, Artificial Sequence
  Synthetic oligonucleotide
ctatctttgtcaaaaacacg

SEQ ID NO: 135 - DNA, 20 bp, Artificial Sequence
  Synthetic oligonucleotide
aacactttgtgtacatgttt

SEQ ID NO: 136 - DNA, 20 bp, Artificial Sequence
  Synthetic oligonucleotide
tccacaaagcaatgagttca

SEQ ID NO: 137 - DNA, 20 bp, Artificial Sequence
  Synthetic oligonucleotide
tccagagcatttcatcgctg

SEQ ID NO: 138 - DNA, 20 bp, Artificial Sequence
  Synthetic oligonucleotide
aagacttattttctaaaacc

SEQ ID NO: 139 - DNA, 20 bp, Artificial Sequence
  Synthetic oligonucleotide
tcccttgacttggattatac

SEQ ID NO: 140 - DNA, 20 bp, Artificial Sequence
  Synthetic oligonucleotide
aaattaagattattatgctg

SEQ ID NO: 141 - DNA, 20 bp, Artificial Sequence
  Synthetic oligonucleotide
ccttcattttcacaaagcca

SEQ ID NO: 142 - DNA, 20 bp, Artificial Sequence
  Synthetic oligonucleotide
gcaactgataccttaattcg

SEQ ID NO: 143 - DNA, 20 bp, Artificial Sequence
  Synthetic oligonucleotide
gaatagagtttctggaatca

SEQ ID NO: 144 - DNA, 20 bp, Artificial Sequence
  Synthetic oligonucleotide
aggaggccttcagaagtgcg

SEQ ID NO: 145 - DNA, 20 bp, Artificial Sequence
  Synthetic oligonucleotide
aaaattcctttttagattaa

SEQ ID NO: 146 - DNA, 20 bp, Artificial Sequence
  Synthetic oligonucleotide
atttactcaggttatcttcc

SEQ ID NO: 147 - DNA, 20 bp, Artificial Sequence
  Synthetic oligonucleotide
tccacataaacatggaagga

SEQ ID NO: 148 - DNA, 20 bp, Artificial Sequence
  Synthetic oligonucleotide
atcccaactcatagacacct

SEQ ID NO: 149 - DNA, 20 bp, Artificial Sequence
  Synthetic oligonucleotide
tagtaacttccatttgctgc

SEQ ID NO: 150 - DNA, 20 bp, Artificial Sequence
  Synthetic oligonucleotide
aatcaacctcttttaaagaa

SEQ ID NO: 151 - DNA, 20 bp, Artificial Sequence
  Synthetic oligonucleotide
aattcatttgcaataacctt

SEQ ID NO: 152 - DNA, 20 bp, Artificial Sequence
  Synthetic oligonucleotide
gattgtcatggaacaatact

SEQ ID NO: 153 - DNA, 20 bp, Artificial Sequence
  Synthetic oligonucleotide
ttcaaatgataatatagatt

SEQ ID NO: 154 - DNA, 20 bp, Artificial Sequence
  Synthetic oligonucleotide
gaaattcccaagagtagaat

SEQ ID NO: 155 - DNA, 20 bp, Artificial Sequence
  Synthetic oligonucleotide
ggctcagaattgaaaccaaa

SEQ ID NO: 156 - DNA, 20 bp, Artificial Sequence
  Synthetic oligonucleotide
atactaaaaatgtcatcttc

SEQ ID NO: 157 - DNA, 20 bp, Artificial Sequence
  Synthetic oligonucleotide
ccagccttgttggatatcat

SEQ ID NO: 158 - DNA, 20 bp, Artificial Sequence
  Synthetic oligonucleotide
tgaggttcagtaagagcccc

SEQ ID NO: 159 - DNA, 20 bp, Artificial Sequence
  Synthetic oligonucleotide
gatccatttgtgttaagctg

SEQ ID NO: 160 - DNA, 20 bp, Artificial Sequence
  Synthetic oligonucleotide
aggtatttcgagtgtgatta

SEQ ID NO: 161 - DNA, 20 bp, Artificial Sequence
  Synthetic oligonucleotide
taccatagagaaacctaatt

SEQ ID NO: 162 - DNA, 20 bp, Artificial Sequence
  Synthetic oligonucleotide
tgggacttaatgaccttgga

SEQ ID NO: 163 - DNA, 20 bp, Artificial Sequence
  Synthetic oligonucleotide
gtcccagaaaagaatctctc

SEQ ID NO: 164 - DNA, 20 bp, Artificial Sequence
  Synthetic oligonucleotide
tcagtccagctctttagttc

SEQ ID NO: 165 - DNA, 20 bp, Artificial Sequence
  Synthetic oligonucleotide
ttggatccttaaaattttag

SEQ ID NO: 166 - DNA, 20 bp, Artificial Sequence
  Synthetic oligonucleotide
gaatttattattgcatggtg

SEQ ID NO: 167 - DNA, 20 bp, Artificial Sequence
  Synthetic oligonucleotide
gcatgaaattgtcaaagaac

SEQ ID NO: 168 - DNA, 20 bp, Artificial Sequence
  Synthetic oligonucleotide
aatggataattctgaagtct

SEQ ID NO: 169 - DNA, 20 bp, Artificial Sequence
  Synthetic oligonucleotide
agctcatagtaccagtggct

SEQ ID NO: 170 - DNA, 20 bp, Artificial Sequence
  Synthetic oligonucleotide
catggtcatgaaaacaagta

SEQ ID NO: 171 - DNA, 20 bp, Artificial Sequence
  Synthetic oligonucleotide
tagtgacatagttttatggt

SEQ ID NO: 172 - DNA, 20 bp, Artificial Sequence
  Synthetic oligonucleotide
gtataccattcatatttcta

SEQ ID NO: 173 - DNA, 20 bp, Artificial Sequence
  Synthetic oligonucleotide
aagaaacactgagagcctga

SEQ ID NO: 174 - DNA, 20 bp, Artificial Sequence
  Synthetic oligonucleotide
attaggcttattgatgtctg

SEQ ID NO: 175 - DNA, 20 bp, Artificial Sequence
  Synthetic oligonucleotide
aatacaatattattgccatg

SEQ ID NO: 176 - DNA, 20 bp, Artificial Sequence
  Synthetic oligonucleotide
gattaggtgtgctttcagac

SEQ ID NO: 177 - DNA, 20 bp, Artificial Sequence
  Synthetic oligonucleotide
cgggttagaggaagaattat

SEQ ID NO: 178 - DNA, 20 bp, Artificial Sequence
  Synthetic oligonucleotide
tataagccacaaacatcttg

SEQ ID NO: 179 - DNA, 20 bp, Artificial Sequence
  Synthetic oligonucleotide
tcattgtgacagtaaagaaa

SEQ ID NO: 180 - DNA, 20 bp, Artificial Sequence
  Synthetic oligonucleotide
taactgggttaatttactac

SEQ ID NO: 181 - DNA, 20 bp, Artificial Sequence
  Synthetic oligonucleotide
tatgtaggaacatttttagt

SEQ ID NO: 182 - DNA, 20 bp, Artificial Sequence
  Synthetic oligonucleotide
accagttgatcatgttttat

SEQ ID NO: 183 - DNA, 20 bp, Artificial Sequence
  Synthetic oligonucleotide
tacaagctacagataacctg

SEQ ID NO: 184 - DNA, 20 bp, Artificial Sequence
  Synthetic oligonucleotide
tgagagacatttgtctctgg

SEQ ID NO: 185 - DNA, 20 bp, Artificial Sequence
  Synthetic oligonucleotide
atttctacatggtcattcct

SEQ ID NO: 186 - DNA, 20 bp, Artificial Sequence
  Synthetic oligonucleotide
agatgtctatactaagaaac

SEQ ID NO: 187 - DNA, 20 bp, Artificial Sequence
  Synthetic oligonucleotide
caacttaattgctttttgaa

SEQ ID NO: 188 - DNA, 20 bp, Artificial Sequence
  Synthetic oligonucleotide
gatacattatcattgttata

SEQ ID NO: 189 - DNA, 20 bp, Artificial Sequence
  Synthetic oligonucleotide
tctggttttctcaagttcag

SEQ ID NO: 190 - DNA, 20 bp, Artificial Sequence
  Synthetic oligonucleotide
acagttgatatgtgtgtggc

SEQ ID NO: 191 - DNA, 20 bp, Artificial Sequence
  Synthetic oligonucleotide
gcttaattgtccttgagacc

SEQ ID NO: 192 - DNA, 20 bp, Artificial Sequence
  Synthetic oligonucleotide
agtgtcagacctacctatta

SEQ ID NO: 193 - DNA, 20 bp, Artificial Sequence
  Synthetic oligonucleotide
ggcgggttgtattttgagag

SEQ ID NO: 194 - DNA, 20 bp, Artificial Sequence
  Synthetic oligonucleotide
gcaacaagaacttgatttaa

SEQ ID NO: 195 - DNA, 20 bp, Artificial Sequence
  Synthetic oligonucleotide
gtaggcgagtaaattagaat

SEQ ID NO: 196 - DNA, 20 bp, Artificial Sequence
  Synthetic oligonucleotide
actagaaaccgaacttggcg

SEQ ID NO: 197 - DNA, 20 bp, Artificial Sequence
  Synthetic oligonucleotide
ggaatacataagatgagtca

SEQ ID NO: 198 - DNA, 20 bp, Artificial Sequence
  Synthetic oligonucleotide
aaaaagtttctttacttaac

SEQ ID NO: 199 - DNA, 20 bp, Artificial Sequence
  Synthetic oligonucleotide
aggactggtatttagtttgt

SEQ ID NO: 200 - DNA, 20 bp, Artificial Sequence
  Synthetic oligonucleotide
catgaagttttagaatgaaa

SEQ ID NO: 201 - DNA, 20 bp, Artificial Sequence
  Synthetic oligonucleotide
gcatatccattttcaataaa

SEQ ID NO: 202 - DNA, 20 bp, Artificial Sequence
  Synthetic oligonucleotide
aaaaaggcatatttttattt

SEQ ID NO: 203 - DNA, 20 bp, Artificial Sequence
  Synthetic oligonucleotide
tactttcagtcttgtaatac

SEQ ID NO: 204 - DNA, 20 bp, Artificial Sequence
  Synthetic oligonucleotide
gatttccaatattcttcatc

SEQ ID NO: 205 - DNA, 20 bp, Artificial Sequence
  Synthetic oligonucleotide
ccaaacaattttcagatata

SEQ ID NO: 206 - DNA, 20 bp, Artificial Sequence
  Synthetic oligonucleotide
ggtattttcctcaattacat

SEQ ID NO: 207 - DNA, 20 bp, Artificial Sequence
  Synthetic oligonucleotide
gccaccatatggttgctggg

SEQ ID NO: 208 - DNA, 20 bp, Artificial Sequence
  Synthetic oligonucleotide
caggcataagagtcagaagc

SEQ ID NO: 209 - DNA, 20 bp, Artificial Sequence
  Synthetic oligonucleotide
ttgaggaagagggctaattt

SEQ ID NO: 210 - DNA, 20 bp, Artificial Sequence
  Synthetic oligonucleotide
gttttccagtgagtaccagc

SEQ ID NO: 211 - DNA, 20 bp, Artificial Sequence
  Synthetic oligonucleotide
taactagaggaataccaact

SEQ ID NO: 212 - DNA, 20 bp, Artificial Sequence
  Synthetic oligonucleotide
gaaagcatccttagtttctc

SEQ ID NO: 213 - DNA, 20 bp, Artificial Sequence
  Synthetic oligonucleotide
ttgcagcattaattaaacaa

SEQ ID NO: 214 - DNA, 20 bp, Artificial Sequence
  Synthetic oligonucleotide
ggcaattaaattctactttt

SEQ ID NO: 215 - DNA, 20 bp, Artificial Sequence
  Synthetic oligonucleotide
ctggagtttgtgatggttgt

SEQ ID NO: 216 - DNA, 20 bp, Artificial Sequence
  Synthetic oligonucleotide
aggatatattttggcaactt

SEQ ID NO: 217 - DNA, 20 bp, Artificial Sequence
  Synthetic oligonucleotide
tttatcagaaatgcctggga

SEQ ID NO: 218 - DNA, 20 bp, Artificial Sequence
  Synthetic oligonucleotide
gtccatctatcaatttatta

SEQ ID NO: 219 - DNA, 20 bp, Artificial Sequence
  Synthetic oligonucleotide
tttaaatagctgattatctg

SEQ ID NO: 220 - DNA, 20 bp, Artificial Sequence
  Synthetic oligonucleotide
caagagataatagcttaatt

SEQ ID NO: 221 - DNA, 20 bp, Artificial Sequence
  Synthetic oligonucleotide
attagttgataccactcttc

SEQ ID NO: 222 - DNA, 20 bp, Artificial Sequence
  Synthetic oligonucleotide
agtgaaaccagagtagtagt

SEQ ID NO: 223 - DNA, 20 bp, Artificial Sequence
  Synthetic oligonucleotide
catgtggtatatataaaatg

SEQ ID NO: 224 - DNA, 20 bp, Artificial Sequence
  Synthetic oligonucleotide
agcctagactaagaggcgag

SEQ ID NO: 225 - DNA, 20 bp, Artificial Sequence
  Synthetic oligonucleotide
gctaaatatcaaagccctat

What is claimed:

1. A method of treating Angelman syndrome in an animal comprising administering to an animal with Angelman syndrome an antisense compound targeted to UBE3A-ATS, wherein the antisense compound comprises an oligonucleotide consisting of 12 to 30 linked nucleosides, wherein the oligonucleotide is at least 85% complementary to a sequence within nucleobases 446213 to 513602 of SEQ ID NO: 2.

2. The method of claim 1, wherein UBE3A-ATS comprises a nucleic acid sequence at least 85% identical to SEQ ID NO:2.

3. The method of claim 1, wherein the oligonucleotide is at least 90% complementary over its entire length to an equal length region of a UBE3A-ATS nucleic acid sequence.

4. The method of claim 1, wherein the oligonucleotide is at least 95% complementary over its entire length to an equal length region of a UBE3A-ATS nucleic acid sequence.

5. The method of claim 1, wherein the oligonucleotide is 100% complementary over its entire length to an equal length region of a UBE3A-ATS nucleic acid sequence.

6. The method of claim 1, wherein the oligonucleotide is a single-stranded oligonucleotide.

7. The method of claim 6, wherein the oligonucleotide is a modified oligonucleotide.

8. The method of claim 7, wherein the modified oligonucleotide comprises at least one modified internucleoside linkage.

9. The method of claim 8, wherein the modified internucleoside linkage is a phosphorothioate internucleoside linkage.

10. The method of claim 7, wherein at least one nucleoside comprises a modified sugar.

11. The method of claim 10, wherein the modified sugar is a bicyclic sugar comprising a bridge between the 4' and the 2' positions of the sugar.

12. The method of claim 11, wherein the bridge is selected from 4'-CH(CH$_3$)—O-2', 4'-CH$_2$-2', 4'-(CH$_2$)$_2$-2', 4'-CH$_2$—O-2', 4'-(CH$_2$)$_2$—O-2', 4'-CH$_2$—O—N(R$_1$)-2' and 4'-CH2-N(R$_1$)—O-2'- wherein each R1 is, independently, H, a protecting group or C1-C12 alkyl.

13. The method of claim 12, wherein the bridge is 4'-CH(CH$_3$)—O-2'.

14. The method of claim 12, wherein the bridge is selected from 4'-CH$_2$—O-2' and 4'-(CH$_2$)$_2$—O-2'.

15. The method of claim 10, wherein the modified sugar comprises a 2'-O-methoxyethyl group.

16. The method of claim 7, wherein at least one nucleoside comprises a modified nucleobase.

* * * * *